United States Patent 11,624,072 (CANOLA WITH HIGH OLEIC ACID) - sequence listing, part 2

SEQ ID NO: 6279 - DNA, 422 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactgggccaggcccacggcttgcccccggagcagggggtggccatcgccagccacgatggcggcaacagccgctggactggcctctctactgggcctgccagggctgcgtcctaaccggcgtctgggtcatagcccacgagtgcggccaccacgccttcagcgacac

SEQ ID NO: 6280 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaacgggcctctgggtcatagcccacgagtgcggccaccacgccttcagcgactac

SEQ ID NO: 6281 - DNA, 348 bp, Artificial
  Mutation in BnaA.FAD2.a introduced by TALE nuclease pair BnFAD2_T01
caggatccatgggtgcaggtggaagaatgcaggtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggtctctctactgggcctgccaagggtgcgtcctaaccggcgtctgggtcatagcccacgagtgcggccaccacgccttcagcgactac

SEQ ID NO: 6282 - DNA, 350 bp, Artificial
  Mutation in BnaA.FAD2.a introduced by TALE nuclease pair BnFAD2_T01
caggatccatgggtgcaggtgcaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 6283 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacaccttcagcgactac

SEQ ID NO: 6284 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactccgtcgccaccacttacttccctctcctccctcaccccctctcctccttcgtcgcctggcctctctactgggcctgccagggctgcgtcctaaccggcgtctgggtcatagcccacgagtgcggccaccacgccttcagcgactac

SEQ ID NO: 6285 - DNA, 358 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcgggtctggcctctctactgggcctgccagggctgcgtcctaaccggcgtctgggtcatagcccacgagtgcggccaccacgccttcagcgactac

SEQ ID NO: 6286 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccacccttcactgtcggagaactcaagaaagcaatcccaccgcactgtttcaaacgctcgatccctcgctccttctcctacctcctcttcgacatcctcgtctcctcctccctctaccacctctccacagcctacttccctctcctctctccccccctctccttcgcctggcccctctactgggcctgccagggctgcgtcctaacgggcgtctgggtcatcgcccacgagtgcggccaccacgccttcagcgactac

SEQ ID NO: 6287 - DNA, 415 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccatcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttcgctggagacgatggccaccacctgctggggggtcaagttgagcggggcacccgtcagtgcaggcatggcctctctactgggcctgccagggctgcgtcctaaccggcgtctgggtcatagcccacgagtgcggccaccacgccttcagcgactac

SEQ ID NO: 6288 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccagggctgcgtcctaaccggcgtctgggtcatagcccacgagtgcggccaccacgccttcagcgactac

SEQ ID NO: 6289 - DNA, 339 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttactgggcctgccagggctgcgtcctaaccggcgtctgggtcatagcccacgagtgcggccaccacgccttcagcgactac

SEQ ID NO: 6290 - DNA, 350 bp, Artificial
  Mutation in BnaA.FAD2.a introduced by TALE nuclease pair BnFAD2_T01
caggatccatgggtgcaggtggaagaatgcatgtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacgtacttccctgtcctccctcaccctctctcctccatctggcctctctactgggcctgccagggctgcgtcctaaccggcgtctgggtcatagcccacgagtgcggccaccacgccttcagcgactac

SEQ ID NO: 6291 - DNA, 303 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccacctcactgcttcaaacgctccatccctcgctccttctcctacctcctcttcgacatcctcgtctcctccctcaccctctctcctacctctctactgggcctgccagggctgcgtcctaaccggcgtctgggtcatagcccacgagtgcggccaccacgccttcagcgactac

SEQ ID NO: 6292 - DNA, 329 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcaccgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaacgggcctctgggtcatagcccacgagtgcggccaccacgccttcagcgactac

SEQ ID NO: 6293 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttctctctactgggcctgccagggctgcgtcctaaccggcgtctgggtcatagcccacgagtgcggccaccacgccttcagcgactac

SEQ ID NO: 6294 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctactgggcctgccagggctgcgtcctaaccggcgtctgggtcatagcccacgagtgcggccaccacgccttcagcgactac

SEQ ID NO: 6295 - DNA, 338 bp, Artificial
  Mutation in BnaA.FAD2.a introduced by TALE nuclease pair BnFAD2_T01
caggatccatgggtgcaggtggaagaatgcaagtgtctcctccctccaataagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcatagcccacgagtgcggccaccacgccttcagcgactac

SEQ ID NO: 6296 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccagggctgcgtcctaaccggcgtctgggtcatagcccacgagtgcggccaccacgccttcagcgactac

SEQ ID NO: 6297 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcagacgctcgatccctcgctctttctcctacctcatctgggacatcatcatagcctcctgcttctactacgtcgccaccacttacttccctctcctccctcaccctctctcctacttttactgggcctgccagggctgcgtcctaaccggcgtctgggtcatagtccacgagtgcggccaccacgccttcagcgactac

SEQ ID NO: 6298 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctccttctactacgtccccacctcttacttccctctcctccctcaccctctctcctacggcctctctactgggcctgccagggctgcgtcctaaccggcgtctgggtcatagcccacgagtgcggccaccacgccttcagcgactac

SEQ ID NO: 6299 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgggcctctctactgggcctgccagggctgcgtcctaaccggcgtctgggtcatagcccacgagtgcggccaccacgccttcagcgactac

SEQ ID NO: 6300 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcacccactcctctctactgggcctgccagggctgcgtcctaaccggcgtctgggtcatagcccacgagtgcggccaccacaccttcagcgacccc

SEQ ID NO: 6301 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaaccggcgtcggggtcatagcccacgagtgcggccaccacgccttcagcgactac

SEQ ID NO: 6302 - DNA, 401 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggtccagcgcctgcttgccaccattattgctggcgatggccaccacctgctgggcctctctactgggcctgccagggctgcgtcctaaccggcgtctgggtcatagcccacgagtgcggccaccacgccttcagcgactac

SEQ ID NO: 6303 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatggcctctctactgggcctgccaagggtgcgtcctaaccggcctctgggtcatagcccacgagtgcggccaccacgccttcagcgactac

SEQ ID NO: 6304 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgagacatcatcatagcctcctgcttctactacgtcgccaccacttacttccctctcctccctcaccctctctccaactggcctctctactgggcctgccaaggctgcgtcctaatgggcctctgggtcatagcccacgagtgcggccagcacgccttcagcgactac

SEQ ID NO: 6305 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtcttaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctggcctctctactgggcctgccagggctgcgtcctaaccggcgtctgggtcatagcccacgagtgcggccaccacgccttcagcgactac

SEQ ID NO: 6306 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaaccggcgtctgggtcatcgcccacgaatgcggccaccacgccttcagcgactac

SEQ ID NO: 6307 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactaaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccctctctactgggcctgccagggctgcgtcctaaccggcgtctgggtcatagcccacgagtgcggccaccacgccttcagcgactac

SEQ ID NO: 6308 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttcccttggcccctctactgggcctgccaaggctgcggcctaaccggcgtctgggtcatagcccacgagtgcggccaccacgccttcagcgactac

SEQ ID NO: 6309 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaaggctgcgtcctaacgggcctctgggtcatagcccacgagtgcggccaccacgccttcagcgactac

SEQ ID NO: 6310 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttctctctcctccctcaccctctctcctacttctggcctctctactgggcctgccagggctgcgtcctaaccggcgtctgggtcatagcccacgagtgcggccaccacgccttcagcgactac

SEQ ID NO: 6311 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttccagcgactac

SEQ ID NO: 6312 - DNA, 430 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttatgtacggccagcaacgtcggttcgagatggcgctcgatgacgccaacgatggccaccacctgctccggggtcaagccagttggcctctctactgggcctgccagggctgcgtcctaaccggcgtctgggtcatagcccacgagtgcggccaccacgccttcagcgactac

SEQ ID NO: 6313 - DNA, 325 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggctgcgtcctaaccggcgtctgggtcatagcccacgagtgcggccaccacgccttcagcgactac

SEQ ID NO: 6314 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccagggctgcgtcctaacgggcctctgggtcatcgcccactaatgcggccaccacgccttcagcgactac

SEQ ID NO: 6315 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttctctctactgggcctgccaagggtgcgtcctaaacggcgtctgggtcatagcccacgagtgcggccaccacgccttcagcgactac

SEQ ID NO: 6316 - DNA, 434 bp, Artificial
  Mutation in BnaA.FAD2.a introduced by TALE nuclease pair BnFAD2_T01
caggatccatgggtgcaggtggaagaatgcaagtgtccactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcggctgttgccggtgctgtgccaggcccacggcttgaccccccagcaggtggtggccatcgccagcaatggcggtggcaagcaggcgctggaggcctggcctctctactgggcctgccagggctgcgtcctaaccggcgtctgggtcatagcccacgagtgcggccacgacgccttcagcgactac

SEQ ID NO: 6317 - DNA, 341 bp, Artificial
  Mutation in BnaA.FAD2.a introduced by TALE nuclease pair BnFAD2_T01
caggatccatggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaagggtgcgtcctaaccggcgtctgggtcatagcccacgagtgcggccaccacgccttcagcgactac

SEQ ID NO: 6318 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccagggctgcgtcctaacgggcctctgggtcatagcccacgagtgcggccaccacgccttcagcgactac

SEQ ID NO: 6319 - DNA, 387 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccccggagcaggtggtggccatcgccagccacgatggcgcctggcctctctactgggcctgccagggctgcgtcctaaccggcgtctgggtcatagcccacgagtgcggccaccacgccttcagcgactac

SEQ ID NO: 6320 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctccgccgccctctctactgggcctgccagggctgcgtcctaacgggcctctgggtcatagcccacgagtgcggccaccacgccttcagcgactac

SEQ ID NO: 6321 - DNA, 349 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactacggcctctctactgggcctgccaagggtgcgtcctaaccggcgtctgggtcatagcccacgagtgcggccaccacgccttcagcgactac

SEQ ID NO: 6322 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacatcgccaccacttacttccctctcctccctcaccctctctcctacctctctactgggcctgccagggctgcgtcctaaccggcgtctgggtcatagcccacgagtgcggccaccacgccttcagcgactac

SEQ ID NO: 6323 - DNA, 349 bp, Artificial
  Mutation in BnaA.FAD2.a introduced by TALE nuclease pair BnFAD2_T01
caggatccatgggtgcaggcggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 6324 - DNA, 441 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggtggccatcgccagccacgatggtggcaagcaggcgctggagacggtccagcggctgttgccggtgctgtgccaggcccacggcttgacccctggcctctctactgggcctgccaagggtgcgtcctaaccggcgtctgggtcatagcccacgagtgcggccaccacgccttcagcgactac

SEQ ID NO: 6325 - DNA, 347 bp, Artificial
  Mutation in BnaA.FAD2.a introduced by TALE nuclease pair BnFAD2_T01
caggatccatgggtgcatgtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 6326 - DNA, 386 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttggccaccacctgctggggggtcaagccgtgcgcctggcacagtctctactgggcctgccagggctgcgtcctaaccggcgtctgggtcatagcccacgagtgcggccaccacgccttcagcgactac

SEQ ID NO: 6327 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcccctccctcaccctctcccctactctctactgggcctgccagggctgcgtcctaaccggcgtctgggtcatagcccacgagtgcggccaccacgccttcagcgactac

SEQ ID NO: 6328 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctaaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 6329 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaactggcgtctgggtcatagcccacgagtgcggccaccacgccttcagcgactac

SEQ ID NO: 6330 - DNA, 388 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcggtccagcgcctgcttgccaccattattgctggcgatggccaccacctgctgggcctgccagggctgcgtcctaaccggcgtctgggtcatagcccacgagtgcggccaccacgccttcagcgactac

SEQ ID NO: 6331 - DNA, 344 bp, Artificial
  Mutation in BnaA.FAD2.a introduced by TALE nuclease pair BnFAD2_T01
caggatccatgggtgcaggtggaagaatgcaagtgtatgctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccaggcctccgtcctaaccggcctctgggtcatagcccacgagtgcggccaccacgccttcagcgactac

SEQ ID NO: 6332 - DNA, 351 bp, Artificial
  Mutation in BnaA.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgctggcctctctactgggcctgccagggctgcgtcctaaccggcgtctgggtcatagcccacgagtgcggccaccacgccttcacgactac

SEQ ID NO: 6333 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgatacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 6334 - DNA, 377 bp, Artificial
  Mutation in BnaA.FAD2.a introduced by TALE nuclease pair BnFAD2_T01
caggatccatgggtgcaggtggaagaatgcaagtgtctcctcccccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctccagcgcctgcttgccgccatcgtggctggcgatggccaccacctgctccggggtcaagccgtgagggctgggtcatagcccacgagtgcggccaccacgccttcagcgactac

SEQ ID NO: 6335 - DNA, 351 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaaccggcgtctgggtcatagcccacgagtgcggccaccacgccttcagcgactac

SEQ ID NO: 6336 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaacagacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtctgggtcatagcccacgagtgcggccaccacgccttcagcgactac

SEQ ID NO: 6337 - DNA, 342 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctctctactgggcctgccagggctgcgtcctaaccggcgtctgggtcatagcccacgagtgcggccaccacgccttcagcgactac

SEQ ID NO: 6338 - DNA, 312 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccacctcactgcttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 6339 - DNA, 340 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccagggctgcgtcctaaccggcgtctgggtcatagcccacgagtgcggccaccacgccttcagcgactac

SEQ ID NO: 6340 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgagtcatagcccacgagtgcggccaccacgccttcagcgactac

SEQ ID NO: 6341 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatcttggacatcatcatagcctcctgcttctactacgtcgccaccacttacttccctctcctccctccccctccctcctacttcctctctactgggcctgccagggctgcgtcctaaccggcgtctgggtcatagcccacgagtgcggccaccacgccttcagcgactac

SEQ ID NO: 6342 - DNA, 346 bp, Artificial
  Mutation in BnaA.FAD2.a introduced by TALE nuclease pair BnFAD2_T01
ccaggatccatgggtgcaggtggaagaatgcaagagtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagcgactac

SEQ ID NO: 6343 - DNA, 344 bp, Artificial
  Mutation in BnaA.FAD2.a introduced by TALE nuclease pair BnFAD2_T01
caggatccatgggtgcaggtggaagaatgcaagtctctactccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccagggctgcgtcctaaccggcgtctgggtcatagcccacgagtgcggccaccacgccttcagcgactac

SEQ ID NO: 6344 - DNA, 349 bp, Artificial
  Mutation in BnaA.FAD2.a introduced by TALE nuclease pair BnFAD2_T01
caggatccatggggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 6345 - DNA, 390 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttgctggcggtggcaagcacctgctggggggtcaagccgtgggcggcctctctactgggcctgccaagggtgcgtcctaaccggcgtctgggtcatagcccacgagtgcggccaccacgccttcagcgactac

SEQ ID NO: 6346 - DNA, 349 bp, Artificial
  Mutation in BnaA.FAD2.a introduced by TALE nuclease pair BnFAD2_T01
caggatccatgggtgcaggtggaagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 6347 - DNA, 343 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctctggcctctctactgggcctgccagggctgcgtcctaaccggcgtctgggtcatagcccacgagtgcggccaccacgccttcagcgactac

SEQ ID NO: 6348 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcatccctcaccctctctcctacttctggcctctctactgggcctgccaaggctgcgtcctaacgggcctctgggtcatcgcccacgaatgcggccaccacgccttcagcgactac

SEQ ID NO: 6349 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctacccctctctcctccttcgcccctggcctctctactgggcctgccaagggtgcgtcctaaccggcgtctgggtcatagcccacgagtgcgcccaccacgccttcagcgactac

SEQ ID NO: 6350 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatccgggacatcatcatagcctcctgcttctactacgtcgccaccacttacttccctctcctccctcaccctctctcctacttcctggcctctctactgggcctgccagggctgcgtcctaaccggcgtctgggtcatagcccacgagtgcggccaccacgccttcagcgactac

SEQ ID NO: 6351 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccctcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 6352 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaacgcctgaaaccgaaaacctcaagcgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgccgccaccacttacttccctctccaccctcaccctctctcctacttctggcctctctactgggcctgccagggctgcgtcctaaccggcgtctgggtcatagcccacgagtgcggccaccacgccttcagcgactac

SEQ ID NO: 6353 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacggcctctctactgggcctgccagggctgcgtcctaaccggcgtctgggtcatagcccacgagtgcggccaccacgccttcagcgactac

SEQ ID NO: 6354 - DNA, 350 bp, Artificial
  Mutation in BnaA.FAD2.a introduced by TALE nuclease pair BnFAD2_T01
caggatccatgggtgcaggtggaagaatgcaagtctctccttcctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 6355 - DNA, 348 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 6356 - DNA, 344 bp, Artificial
  Mutation in BnaA.FAD2.a introduced by TALE nuclease pair BnFAD2_T01
caggatccatgggtgcaggttgaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcttggcctctctactgggcctgccaagggtgcgtcctaaccggcgtctgggtcatagcccacgagtgcggccaccacgccttcagcgactac

SEQ ID NO: 6357 - DNA, 348 bp, Artificial
  Mutation in BnaA.FAD2.a introduced by TALE nuclease pair BnFAD2_T01
catgatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 6358 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctaatctgggacatcatcatagcctcctgcttctactacgtcgccaccacttacttccctctcctccctcaccctctctcccgcctggcctctctactgggcctgccaagggtgcgtcctaaccggcgtctgggtcatagcccacgagtgcggccaccacgccttcagcgactac

SEQ ID NO: 6359 - DNA, 409 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctcccctgcgtcgcgggagacggtgcaggcgctgttgccggtgctgtgccaggcccacggcttgacccccctggcctctctactgggcctgccagggctgcgtcctaaccggcgtctgggtcagagcccacgagtgcggccaccacgccttcagcgactac

SEQ ID NO: 6360 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcccctctactgggcctgccaaggctgcgtcctaacgggcctctgggtcatagcccacgagtgcggccaccacgccttcagcgactac

SEQ ID NO: 6361 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcacagtttcaaacgctcgatcccacgctctttctcctacctcatctgggacatcatcatagcctcctgcttctactacgtcgccaccacttacttccatctcctccctcaccctctctcctactgcgccgcctggcctctctactgggcctgccaagggtgcgtcctaaccggcgtctgggtcatagcccacgagtgcggccaccacgccttcagcgactac

SEQ ID NO: 6362 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcctctctactgggcctgccagggctgcgtcctaaccggcgtctgggtcatagcccactagtgcggccaccacgccttcagcgactac

SEQ ID NO: 6363 - DNA, 341 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttactgggcctgccagggctgcgtcctaaccggcgtctgggtcatagcccacgagtgcggccaccacgccttcagcgactac

SEQ ID NO: 6364 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagtgcggccaccacgccttcagcgactac

SEQ ID NO: 6365 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttaccttgacccctctactgggcctgccaaggctgcgtcctaacgggcctctgggtcatagcccacgagtgcggccaccacgccttcagcgactac

SEQ ID NO: 6366 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggataactcaagaaagcaatcccaccgcactgtttcaaacgctccatccctcgctctttctcctacctcatctgggacatcatcatagcctcctgcttctactacgtcgcccccacttacttccctctcctccctccccctctctcccacttggcctctctactgggcctgccaagggtgcgtcctaaccggcgtctgggtcatagcccacgagtgcggccaccacgccttcagcgactac

SEQ ID NO: 6367 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcatggcctctctactgggcctgccagggctgcgtcctaaccggcgtctgggtcatagcccacgagtgcggccaccacgccttcagcgactac

SEQ ID NO: 6368 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccatctctcctactctggcctctctactgggcctgccaagggtgcgtcctaaccggcgtctgggtcatagcccacgagtgcggccaccacgccttcagcgactac

SEQ ID NO: 6369 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcctccctcaccctctctcctacttggcctctctactgggcctgccagggctgcgtcctaaccggcgtctgggtcatagcccacgagtgcggccaccacgccttcagcgactac

SEQ ID NO: 6370 - DNA, 341 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctttactgggcctgccagggctgcgtcctaaccggcgtctgggtcatcgcccacgaatgcggccaccacgccttcagcgactac

SEQ ID NO: 6371 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcataaccggcgtctgggtcatagcccacgagtgcggccaccatgccttcagcgactcc

SEQ ID NO: 6372 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgcctctctactgggcctgccagggctgcgtcctaaccggcgtctgggtcatagcccacgagtgcggccaccacgccttcagcgactac

SEQ ID NO: 6373 - DNA, 324 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgtccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcttgccaagggtgcgtcctaaccggcgtctgggtcatagcccacgagtgcggccaccacgccttcagcgactac

SEQ ID NO: 6374 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcaccaccacttacttccctctcctccctcaccctctctcctacggcctctctactgggcctgccagggctgcgtcctaaccggcgtctgggtcatagcccacgagtgcggccaccacgccttcagcgactac

SEQ ID NO: 6375 - DNA, 410 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcccgccaccctccgggccgttgcttcacaacgttcaaatccgctcccggcggatttgtctggcctctctactgggcctgccagggctgcgtcctaaccggcgtctgggtcatagcccacgagtgcggccaccacgccttcagcgactac

SEQ ID NO: 6376 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactcc

SEQ ID NO: 6377 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccgctggcctctctactgggcctgccagggctgcgtcctaaccggcgtctgggtcatagcccacgagtgcggccaccacgccttcagcgactac

SEQ ID NO: 6378 - DNA, 355 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcgctggcctctctactgggcctgccacggctgcgtcctaaccggcgtctgggtcatagcccacgagtgcggccaccacgccttcagcgactac

SEQ ID NO: 6379 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaaggctgcgtcctaacgggcctctgggtcatagcccacgagtgcggccaccacgccttcagcgactac

SEQ ID NO: 6380 - DNA, 347 bp, Artificial
  Mutation in BnaA.FAD2.a introduced by TALE nuclease pair BnFAD2_T01
caggatccattggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 6381 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcggcctctctactgggcctgccaagggtgcgtcctaaccggcgtctgggtcatagcccacgagtgcggccaccacgccttcagcgactac

SEQ ID NO: 6382 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctgtcctgccgcgtggcctctctactgggcctgccagggctgcgtcctaaccggcgtctgggtcatagcccacgagtgcggccaccacgccgtcagcgactac

SEQ ID NO: 6383 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggcctgccagggctgcgtcctaacgggcctctgggtcatagcccacgagtgcggccaccacgccttcagcgactac

SEQ ID NO: 6384 - DNA, 329 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatccaaccgcactgtttcaaacgctcgatccctcgctctttctcctacctcatctgggacatcatcatagcctcctgcttctactacgtcgtcaccacttacttccctctcctccctcaccctctctgggcctgccagggctgcgtcctaaccggcgtctgggtcatagcccacgagtgcggccaccacgccttcagcgactac

SEQ ID NO: 6385 - DNA, 357 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcgcctggcctctctacagggcctgtcatggctgcgtcctaaccggcgtctgggtcatagcccgcgagtgcggccaccacgccttcagcgactac

SEQ ID NO: 6386 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccttctcctccctcaccctctctcctacttccctctctactgggcctgccagggctgcgtcctaaccggcgtctgggtcatagcccacgagtgcggccaccacgccttcagcgactac

SEQ ID NO: 6387 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccggaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 6388 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttggcctctctactgggcctgccagggctgcgtcctaaccggcgtctgggtcatagcccacgagtgcggccaccacgccttcagcgactac

SEQ ID NO: 6389 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgtggcctctctactgggcctgccagggctgcgtcctaaccggcgtctgggtcatagcccacgagtgcggccaccacgccttcagcgactac

SEQ ID NO: 6390 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcaccaccacttacttccctctcctccctcaccctctctcctacggcctctctactgggcctgccagggctgcgtcctaaccggcgtctgggtcatagcccacgagtgcggccaccacgccttcagcgactac

SEQ ID NO: 6391 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttatggcctctctactgggcctgccagggctgtgtcctaaccggcgtctgggtcatagcccacgagtgcggccaccacgccttcagcgactac

SEQ ID NO: 6392 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactttttcaaacgctcgatccctcgctctttctcctacctcatctgggacatcatcatagcctcctgcttctactacgtcgccaccacttacttccctctcctccctcaccctctctccgactggcctctctactgggcctgccagggctgcgtcctaaccggcgtctgggtcatagcccacgagtgcggccaccacgccttcagctacgac

SEQ ID NO: 6393 - DNA, 354 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttggcctctctactgggcctgccagggctgcgtcctaaccggcgtctgggtcatagcccacgagtgcggccaccacgccttcagcgactac

SEQ ID NO: 6394 - DNA, 424 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccgccttctccagcgcccgcttgccgccatcgtggctggcgatcgccaccccctgctccggggtcaagcaggtggtggccactggcctctctactgggcctgccagggctgcggcctaaccggcgtctgggtcatagcccacgagtgcggccaccacgccttcagcgactac

SEQ ID NO: 6395 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctagccggcgtctgggtcatagcccacgagtgcggccaccacgccttcagcgactac

SEQ ID NO: 6396 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatcccacgctccttctcctcttcgacatcatcatagcctcctgcttctactacgtcgccaccacttacttccctctcctccctcaccctctctcctacttcgtggcctctctactgggcctgccaagggtgcgtcctaaccggcgtctgggtcatagcccacgagtgcggccaccacgccttcagcgactac

SEQ ID NO: 6397 - DNA, 331 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaacaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctccgggcctgccagggctgcgtcctaaccggcgtcttggtcatagcccacgagtgcggccaccacgccttcagcgactac

SEQ ID NO: 6398 - DNA, 341 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttactgggcctgccagggctgcgtcctaaccggcgtctgggtcatagcccacgagtgcggccaccacgccttcagcgactac

SEQ ID NO: 6399 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccagggctgcgtcctaacgggcctctgggtcatcgcccacgaatgcggccaccacgccttcagcgactac

SEQ ID NO: 6400 - DNA, 341 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccctctactgggcctgccagggctgcgtcctaacgggcctctgggtcatagcccacgagtgcggccaccacgccttcagcgactac

SEQ ID NO: 6401 - DNA, 349 bp, Artificial
  Mutation in BnaA.FAD2.a introduced by TALE nuclease pair BnFAD2_T01
caggatccatgggtgcaggtgaaagaatgcaagtgtctcctccctccaaaaagtctgaaaccgacaacatcaagcgcgtaccctgcgagacaccgcccttcactgtcggagaactcaagaaagcaatcccatcgcactgtttcaaacgctccatccctcgctccttctcctacctcctcttcgacatcctcgtctcctcctccctctaccacctctccacagcctacttccctctcctccctcaccctctctcctactttggcctctctactgggcctgccaagggtgcgtcctaaccggcgtctggggcatagcccacgagtgcggccaccacgccttcagcgactac

SEQ ID NO: 6402 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctttactgggcctgccagggctgcgtcctaaccggcgtctgggtcatagcccacgagtgcggccaccacgccttcagcgactac

SEQ ID NO: 6403 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatctcaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 6404 - DNA, 312 bp, Artificial
  Mutation in BnaA.FAD2.a introduced by TALE nuclease pair BnFAD2_T01
caggatccatgggtgcaggtggaagaatgcaagtgtctcctccctcaaaaaagtctgaaaccgacaacatcaagcgcgtaccctgcgagacaccgcccttcactgtcggagaactcaagaaagcaatcccaccccactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 6405 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcgctggcctctctactgggcctgccagggctgcgtcctaaccggcgtatgggtcatagcccacgagtgcggccaccacgccttcagcgactac

SEQ ID NO: 6406 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 6407 - DNA, 339 bp, Artificial
  Mutation in BnaA.FAD2.a introduced by TALE nuclease pair BnFAD2_T01
caggatccatgggtgcaggtggaagaatgcaagtgtcaccaccctccaagaagtctgaaaccgacaccataaagcgcgtaccctgcgagacaccgcccttcactgtcggagaactcaagaaagcaatcccaccgcactgtttcaaacgctcgatccctcgctctttctcctacctcatctgggacatcaccatagcctcctgcttctactacgtcgccaccacttactgccctctcctccctcaccctctctcctctctactgggcttgccagggctgcgtcctaaccgtcgtctgggtcatagcccacgaggtcggccaccacgccttcagctactac

SEQ ID NO: 6408 - DNA, 344 bp, Artificial
  Mutation in BnaA.FAD2.a introduced by TALE nuclease pair BnFAD2_T01
caggatccatgggtgcaggtgaaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgggcctgccagggctgcgtcctaaccggcgtcggggtcatagcccacgagtgcggccaccacgccttcagcgactac

SEQ ID NO: 6409 - DNA, 356 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcactctctctcctacttcgccgcctggcctctctacgggtcctgccaagggtgcgtcctaaccggcgtctgggtcatagcccacgagagcggcctccacgccttcagcgactac

SEQ ID NO: 6410 - DNA, 331 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgggcctgccagggctgcgtcctaaccggcgtctgggtcatagcccacgagtgcggccaccacgccttcagcgactac

SEQ ID NO: 6411 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccacaacttacttccctctcctccctcaccctctctcctgggcctgccagggctgcgtcctaaccggcgtctgggtcatagcccacgagtgcggccaccacgccttcagcgactac

SEQ ID NO: 6412 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaggtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtctgggtcatagcccacgagtgcggccaccacgccttcagcgactac

SEQ ID NO: 6413 - DNA, 356 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaccgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctacggggcctgccagggctgcgtcctaacgggcctctgggtcatagcccacgagtgcggccaccacgccttcagcgactac

SEQ ID NO: 6414 - DNA, 348 bp, Artificial
  Mutation in BnaA.FAD2.a introduced by TALE nuclease pair BnFAD2_T01
caggatccatgggtgcaggtggaagaatgcaagtgtctcctccccccaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagtgcggccacaacgccttcagcgactac

SEQ ID NO: 6415 - DNA, 312 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgcttcaaacgctccatcccacgctccttctcctcttcgacatcatcatctcctcctcggctcctccctcaccctctctcctacttggcctctctactgggcctgccaagggtgcgtcctaaccggcgtctgggtcatagcccacgagtgcggccaccacgccttcagcgactac

SEQ ID NO: 6416 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctacggggcctgccagggctgcgtcctaacgggcctctgggtcatagcccacgagtgcggccaccacgccttcagcgactac

SEQ ID NO: 6417 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactactgggcctgccaagggtgcgtcctaaccggcgtctgggtcatagcccacgagtgcggccaccacgccttcagcgactac

SEQ ID NO: 6418 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcgctggcctctctactgggcctgccagggctgcgtcctaaccggcgtctgggtcatagcccacgagtgcggccaccacgccttcagcgactac

SEQ ID NO: 6419 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaacccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccgcaccctctctcctacgctggcctctctactgggcctgccagggctgcgtcctatccggcgtctgggtcatagcccacgagtgctgccaccacgccttcagcgactac

SEQ ID NO: 6420 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaacgggcctctgggtcatagcccacgagtgcggccaccacgccttcagcgactac

SEQ ID NO: 6421 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctactacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 6422 - DNA, 347 bp, Artificial
  Mutation in BnaA.FAD2.a introduced by TALE nuclease pair BnFAD2_T01
caggatccattggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 6423 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaacgggcctctgggtcatcgcccacgaatgcggccaccacgccttcagcgactac

SEQ ID NO: 6424 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcatacctcatctgggacatcatcatagcctcctacttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 6425 - DNA, 413 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacccggcggatttgtcctactcaggagagcgttcaccgacaaacaacagataaaacgaaaggcccagtcggcctctctactgggcctgccaagggtgcgtcctaaccggcgtctgggtcatagcccacgagtgcggccaccacgccttcagcgactac

SEQ ID NO: 6426 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttctctactgggcctgccagggctgcgtcctaaccggcgtctgggtcatagcccacgagtgcggccaccacgccttcagcgactac

SEQ ID NO: 6427 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccactctcctacggcctctctactgggcctgccagggctgcgtcctaaccggcgtctgggtcatagcccacgagtgcggccaccacgccttcagcgactac

SEQ ID NO: 6428 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcccctctactgggcctgccaaggctgcgtcctaacgggcctctgggtcatcgcccacgaatgcggccaccacgccttcagcgactac

SEQ ID NO: 6429 - DNA, 338 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaacgggcctctgggtcatcgcccacgaatgcggccaccacgccttcagcgactac

SEQ ID NO: 6430 - DNA, 325 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttggctgcgtcctaaccggcgtctgggtcatagcccacgagtgcggccaccacgccttcagcgactac

SEQ ID NO: 6431 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatggcctctctactgggcctgccaagggtgcgtcctaaccgtcgtctgggtcatagcccacgagtgcggccaccacgccttcagcgactac

SEQ ID NO: 6432 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctaggcctctctactgggcctgccagggctgcgtcctaaccggcgtctgggtcatagcccacgagtgcggccaccacgccttcagcgacta

SEQ ID NO: 6433 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgaaccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgctgccaccacgccttcagcgactac

SEQ ID NO: 6434 - DNA, 433 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctcgatccctcgctctttctcctacctcatctgggacatcatcatagcctcctgcttctactacgtcgccaccacttacttccctctcctccctcaccctcggctgttgccggtgctgggccaggcccccggcttgaccccccagcgggtggtggccatcgccagcaatggcggtggcaacagccgctggaggcctggcctctctactgggcctgccagggctgcgtcctaaccggcgtctgggtcatagcccacgagtgcggccaccacgccttcagcgactac

SEQ ID NO: 6435 - DNA, 350 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctacctctggcctctctactgggcctgccaaggctgcgtcctaacgggcctctgggtcatagcccacgagtgcggccaccacgccttcagcgactac

SEQ ID NO: 6436 - DNA, 328 bp, Artificial
  Mutation in BnaA.FAD2.a introduced by TALE nuclease pair BnFAD2_T01
caggatcctgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctgggcctgccagggctgcgtcctaaccggcgtctgggtcatagcccacgagtgcggccaccacgccttcagcgactac

SEQ ID NO: 6437 - DNA, 344 bp, Artificial
  Mutation in BnaA.FAD2.a introduced by TALE nuclease pair BnFAD2_T01
caggatccatgggtgcaggtcgaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcacctagcctctctactgggcctgccagggctgcgtcctagccggcgtctgggtcatagcccacgagtgcggccaccacgccttcagcgactac

SEQ ID NO: 6438 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccaagggtgcgtcctaaccggcgtcgaggtgaaagcccacgagtgcggtcaccacgccttcagcgactac

SEQ ID NO: 6439 - DNA, 335 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctactgggcctgccagggctgcgtcctaacgggcctctgggtcatagcccacgagtgcggccaccacgccttcagcgactac

SEQ ID NO: 6440 - DNA, 343 bp, Artificial
  Mutation in BnaA.FAD2.a introduced by TALE nuclease pair BnFAD2_T01
caggatccatgggtgctggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaaccggcgtctgggtcatagcccacgagtgcggccaccacgccttcagcgactac

SEQ ID NO: 6441 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacatcgcccttcactgtcggataactcaagaaagcaatcccaccgcactgcttcaaacgctccatccctcgctccttctcctacctcatctgggacatcatcatagcctcctgcttctactacgtcgccaccacttacttccctctcctccctcaccctctcccccgcctctctactgggcctgccagggctgcgtcctaaccggcgtctgggtcatatcccacgagtgcggccaccacgccttcagcgactac

SEQ ID NO: 6442 - DNA, 351 bp, Artificial
  Mutation in BnaA.FAD2.a introduced by TALE nuclease pair BnFAD2_T01
caggatccatgggtgcaggcacaagaatgcaagtctctcctccctccagctcccccggacccaacaccctcaaacgcgtcccctgcgagacaccaccattcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacctcctggcctctctactgggcctgccagggctgcgtcctaaccggcgtctggggcatagcccacgagtgcggcctccacgccttcagcgactac

SEQ ID NO: 6443 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 6444 - DNA, 344 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctcgcctggcctctctactgggcctgccagggctgcgtcctaaccggcgtctgggtcagagcccacgagtgcggccaccacgccttcagcgactac

SEQ ID NO: 6445 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatcccacgctccttctcctcttcgacatcatcatctcctcctccctctaccacctctccacagcctacttccctctcctcccccaccctctcccttacctcgccggcctctctactgggcctgccagggctgcgtcctaaccggcgtcggggtcatagcccacgagtgcggccaccacgccttcagcgactac

SEQ ID NO: 6446 - DNA, 343 bp, Artificial
  Mutation in BnaA.FAD2.a introduced by TALE nuclease pair BnFAD2_T01
caggatccatgggtgcaggtggaagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagggcgcccacctcgccttcagcgactac

SEQ ID NO: 6447 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgctccctcgctctttctcctacctcatctgggacatcatcatagcctcctgcttctactacgtcgccaccacttacttccctctcctccctcaccctctctccgacttccctctctactgggcctgccagggctgcgtcctaaccggcgtctgggtcatagcccacgagtgcggccaccacgccttcagcgactac

SEQ ID NO: 6448 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtttgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccagggctgcgtcctaaccggcgtctgggtcatagcccacgagtgcggccaccacgccttcagcgactac

SEQ ID NO: 6449 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttactcccctctcctccctcaccctctctcctacttggcctctctactgggcctgccagggctgcgtcctaaccggcgtctgggtcatagcccacgagtgcggccaccacgccttcagcgactac

SEQ ID NO: 6450 - DNA, 346 bp, Artificial
  Mutation in BnaA.FAD2.a introduced by TALE nuclease pair BnFAD2_T01
caggatccatgagtgcaggtggaagaatgcaagtgtctcctccctccaagaagtctgaaaccgacaccatcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgaatgcggccaccacgccttcagcgactac

SEQ ID NO: 6451 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatccctcgctccttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 6452 - DNA, 325 bp, Artificial
  Mutation in BnaA.FAD2.a introduced by TALE nuclease pair BnFAD2_T01
caggatccatgggtgcaggtgcaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggctgcgtcctaaccggcgtctgggtcatagcccacgagtgcggccaccacgccttcagcgactac

SEQ ID NO: 6453 - DNA, 352 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccagggctgcgtcctaaccggcgtctgggtcatagcccacgagtgcggccaccacgccttcagcgactac

SEQ ID NO: 6454 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagccaacgagtgcggccaccacgccttcagcgactac

SEQ ID NO: 6455 - DNA, 347 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctccctcaccctctctcctaatggcctctctactgggcctgccagggctgcgtcctaaccggcgtctgggtcatagcccacgagtgcggccaccacgccttcagcgactac

SEQ ID NO: 6456 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaacgggcctctgggtcatagcccacgagtgcggccaccacgccttcatcgactac

SEQ ID NO: 6457 - DNA, 347 bp, Artificial
  Mutation in BnaA.FAD2.a introduced by TALE nuclease pair BnFAD2_T01
caggatccatgggtgcaggtgcaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctacggggcctgccagggctgcgtcctaaccggcgtctgggtcatagcccacgagtgctgcctccgcgccttcagcgactac

SEQ ID NO: 6458 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtatgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctggcctctctactgggcctgccaagggtgcgtcctaaccggcgtctgggtcatagcccacgagtgcggccaccacgccttcagcgactac

SEQ ID NO: 6459 - DNA, 346 bp, Artificial
  Mutation in BnaA.FAD2.a introduced by TALE nuclease pair BnFAD2_T01
caggatccatgggtgcaggtggaagaatgcaagtgcctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaaggctgcgtcctaaccggcgtctgggtcatagcccacgagtgcggccaccacgccttcagcgactac

SEQ ID NO: 6460 - DNA, 350 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctccatccctcgctctttctcctacctcatctgggacatcatcatagcctcctgcttctactacgccgccaccacttacttccctctcctccctccccctctctcctactcctggcctctctactgggcctgccagggctgcgtcctaacgggcctctgggtcatagcccacgagtgcggccaccacgccttcagcgactac

SEQ ID NO: 6461 - DNA, 430 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccccctcctccctcaccctctctcctacttatgtacggccagcaacgtcggttcgagatggcgctcgatgacgccaacgatggccaccacctgctccggggtcaagccagttggcctctctactgggcctgccagggctgcgtcctaaccggcgtctgggtcatagcccacgagtgcggccaccacgccttcagcgactac

SEQ ID NO: 6462 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctccctcaccctctctcctacttgcctctctactgggcctgccagggctgcgtcctaacgggcctctgggtcatagcccacgagtgcggccaccacgccttcagcgactac

SEQ ID NO: 6463 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccggcgtggcctctctactgggcctgccaagggtgcgtcctaaccggcgtctgggtcatagcccacgagtgcggccagcacggcggcagcgactac

SEQ ID NO: 6464 - DNA, 405 bp, Artificial
  Mutation in BnaA.FAD2.a introduced by TALE nuclease pair BnFAD2_T01
caggatccatgggtgcaggtggaagaatgcaagtgcctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcaatgcactgacgggtgccccgctcaacttgaccccccagcaggtggtggccatcggcctctctactgggcctgccaagggtgcgtcctaaccggcgtctgggtcatagcccacgagtgcggccaccacgccttcagcgactac

SEQ ID NO: 6465 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgggcctctctactgggcctgccagggctgcgtcctaaccggcgtctgggtcatagcccacgagtgcggccaccacgccttcagcgactac

SEQ ID NO: 6466 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacctcgccaccacttacttccctctcctccctcaccctctctcctcgcctggcctctctactgggcctgccagggctgcgtcctaaccggcgtctgggtcatagcccacgagtgcggccaccacgccttcagcgactac

SEQ ID NO: 6467 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctggggcatatcccacgagtgcggccaccacgccatcagcgactac

SEQ ID NO: 6468 - DNA, 331 bp, Artificial
  Mutation in BnaA.FAD2.a introduced by TALE nuclease pair BnFAD2_T01
caggatccatggatgcaggtggaagaatgcaagtgtctcctccctccaagaagtctgaaaccgacaccatcaagcgcgtaccctgcgagacaccgccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctccgggcctgccagggctgcgtcctaaccggcgtctgggtcatagcccacgagtgcggccaccacgccttcagcgactac

SEQ ID NO: 6469 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacagcactgtttcaaacgctcgatccctcgctctttctcctacctcatctgggccatcatcatagcctcctgcttctactacgtcgccaccacttacttccctctcctccctcaccctctctcctacttcgcgcctggcctctctactgggcctgccaagggtgcgtcctaaccggcgtctgggtcatagcccacgagtgcggccaccacgccatcagcgactac

SEQ ID NO: 6470 - DNA, 340 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctccaccacttacttccctctcctccctcaccctctctcctactttactgggcctgccagggctgcgtcctaaccggcgtctggggcatagcccacgagtgcggccaccacgccttcagcgactac

SEQ ID NO: 6471 - DNA, 260 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcccttaccacgccttcagcgactac

SEQ ID NO: 6472 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttttactgggcctgccagggctgcgtcctaaccggcgtctgggtcatagcccacgagtgcggccaccacgccttcagcgactac

SEQ ID NO: 6473 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcctgccaagggtgcgtcctaaccggcgtctggggcatagcccacgagtgcggccaccacgccttcagcgactac

SEQ ID NO: 6474 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcataccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcagagcccacgagtgcggccaccacgccttcagcgactac

SEQ ID NO: 6475 - DNA, 349 bp, Artificial
  Mutation in BnaA.FAD2.a introduced by TALE nuclease pair BnFAD2_T01
caggatccatgggtgcaggttgaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctactttggcctctctactgggcctgccaagggtgcgtcctaaccggcgtctgggtcatagcccacgagtgcggccaccacgccttcagcgactac

SEQ ID NO: 6476 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatccctcgctccttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 6477 - DNA, 337 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgcggccaccacgccttctcagcgactac

SEQ ID NO: 6478 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgctgccaccacgccttcagcgactac

SEQ ID NO: 6479 - DNA, 349 bp, Artificial
  Mutation in BnaA.FAD2.a introduced by TALE nuclease pair BnFAD2_T01
caggatccatgggtgcaggtggaagaatgcgagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgcctctctactgggcctgccagggctgcgtcctaaccggcgtctgggtcatagcccacgagtgcggccaccacgccttcagcgactac

SEQ ID NO: 6480 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcctctctactgggcctgccaaggctgcgtcctaacgggcctctgggtcatagcccacgagtgcggccaccacgccttcagcgactac

SEQ ID NO: 6481 - DNA, 347 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcctcctaaccggcgtctgggtcatagcccacgagtgcggccaccacgccttcagcgactac

SEQ ID NO: 6482 - DNA, 412 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgctggagacggtccagcggctgttgccggtgctgtgccaggcccacggcttgaccccggagctggcccctctactgggcctgccaagggtgcgtcctaaccggcgtctgggtcatagcccacgagtgcggccaccacgccttcagcgactac

SEQ ID NO: 6483 - DNA, 350 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcacacgagtgcggccaccacgccttcagcgactac

SEQ ID NO: 6484 - DNA, 343 bp, Artificial
  Mutation in BnaA.FAD2.a introduced by TALE nuclease pair BnFAD2_T01
cagtatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaaccggcgtctgggtcatagcccacgagtgcggccaccacgccttcagcgactac

SEQ ID NO: 6485 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaacctacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 6486 - DNA, 437 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcacctagggccagcggctgtggccgccagcgtggcgggggatggccaccaccggctccggggtcaagccgtgggcctggcacagcaccggcaacagccgctctctctactgggcctgccagggctgcgtcctaaccggcgtctgggtcatagcccacgagtgcggccaccacgccttcagcgactac

SEQ ID NO: 6487 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaaccctgaaaccgacaacatcaagcgcgtaccctgcgagccaccgcccttcactgtcggagaactcaagaaagcaatcccaccgcactgtttcaaacgctcgatccctcgctctttctcatacctcatctgggacatcatcatagcctcctgcttctactacgtcgccaccacttacttccctctcctccctcaccctctctcctactcctggcctctctactgggcctgccaagagtgcgtcctaaccggcgtctgggtcatagcccacgagtgcggccaccacgccttcagccactac

SEQ ID NO: 6488 - DNA, 339 bp, Artificial
  Mutation in BnaA.FAD2.a introduced by TALE nuclease pair BnFAD2_T01
caggatccatgggtgcaggtggaagaatgcaagtgtctcatccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccagggctgcgtcctaacgggcctctgggtcatcgcccacgaatgcggccaccacgccttcagcgactac

SEQ ID NO: 6489 - DNA, 386 bp, Artificial
  Mutation in BnaA.FAD2.a introduced by TALE nuclease pair BnFAD2_T01
caggatccatgggtgcaggtggaagaatgcaagtgtatcctcctttcaaaaagtctgaaaccgacaacatcaagcgcgtaccctgcgagacaccgcccttcactgtcggagaactcaagaaagcaatcccaccgccctgtttcaaacgctcgatcccgcgctctttctcctacctcatctgggacatcatcatagcctcctgcttctactacgtcgccaccccttacttccctctcctccctcacccgccctcctgcttggccaccacctgctgggggttcaagccgtgggccgggcacagtctctactgggcctgccaagagtgcgtcctaaccggcgtctgggtcataaaccaccagtgcggccaccacgccttcatcgactcc

SEQ ID NO: 6490 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgagcctgccaagggtgcgtcctaaccggcgtctgggtcatagcccacgagtgcggccaccacgccttcagcgactac

SEQ ID NO: 6491 - DNA, 342 bp, Artificial
  Mutation in BnaA.FAD2.a introduced by TALE nuclease pair BnFAD2_T01
caggaccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctggcctctctactgggcctgccagggctgcgtcctaaccggcgtctgggtcatagcccacgagtgcggccaccacgccttcagcgactac

SEQ ID NO: 6492 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactagcctctctactgggcctgccagggctgcgtcctaaccggcgtctgggtcatagcccacgagtgcggccaccacgccttcagcgactac

SEQ ID NO: 6493 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctaccgggcctgccagggctgcgtcctaacgggcctctgggtcatagcccacgagtgcggccaccacgccttcagcgactac

SEQ ID NO: 6494 - DNA, 276 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgccttgagcgactac

SEQ ID NO: 6495 - DNA, 331 bp, Artificial
  Mutation in BnaA.FAD2.a introduced by TALE nuclease pair BnFAD2_T01
caggatccatgggtgcaggtgcaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgggcctgccagggctgcgtcctaaccggcgtcggggtcatagcccacgagtgcggccaccacgccttcagcgactac

SEQ ID NO: 6496 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccttggcctctctactgggcctgccagggctgcgtcctaaccggcgtctggggcatagcccacgagtgcggccaccacgccttcagcgactac

SEQ ID NO: 6497 - DNA, 346 bp, Artificial
  Mutation in BnaA.FAD2.a introduced by TALE nuclease pair BnFAD2_T01
aggtccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttggcctctctactgggcctgccagggctgcgtcctaacgggcctctgggtcatagcccccgagtgcggccaccacgccttcaccgactac

SEQ ID NO: 6498 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaacgggcctctgggtcatcgcccacgaatgcggccaccacgccttcagcgactac

SEQ ID NO: 6499 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgtcctaaccggcgtctgggtcatagcccacgagtgcggccaccacgccttcagcgactac

SEQ ID NO: 6500 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccaagggtgcgtcctaaccggcgtctgggtcatagcccacgagtgcggccaccacgccttcagcgacta

SEQ ID NO: 6501 - DNA, 357 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccaccaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccgcccgcctggcctctctactgggcctgccagggctgcgtcctaaccggcgtctgggtcatagcccacgagtgcggccaccacgccttcagcgactac

SEQ ID NO: 6502 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtcagaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaacgggcctctgggtcatcgcccacgaatgcggccaccacgccttcagcgactac

SEQ ID NO: 6503 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccgggcctctctactgggcctgccagggctgcgtcctaaccggcgtctgggtcatagcccacgagtgtggccaccacgccttcagcgactac

SEQ ID NO: 6504 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggttatagcccacgagtgcggccaccacgccttcagcgactac

SEQ ID NO: 6505 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggtctctctactgggcctgccagggctgcgtcctaaccggcgtctgggtcatagcccacgagtgctgccaccacgccttcagcgactac

SEQ ID NO: 6506 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctagccgacgtcggggtcatagcccacgagtgcggccaccacgccttcagcgactac

SEQ ID NO: 6507 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcatcctctctcctcctctctactgggcctgccagggctgcgtcctaaccggcgtctgggtcatagcccacgagtgcggccaccacgccttcagcgactac

SEQ ID NO: 6508 - DNA, 352 bp, Artificial
  Mutation in BnaA.FAD2.a introduced by TALE nuclease pair BnFAD2_T01
caggatccatgggtgtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 6509 - DNA, 340 bp, Artificial
  Mutation in BnaA.FAD2.a introduced by TALE nuclease pair BnFAD2_T01
cagtatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttactgggcctgccagggctgcgtcctaaccggcgtctgggtcatagcccacgagtgcggccaccacgccttcagcgactac

SEQ ID NO: 6510 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctctactgggcctgccaaggctgcgtcctaacgggcctctgggtcatcgcccacgaatgcggccaccacgccttcagcgactac

SEQ ID NO: 6511 - DNA, 387 bp, Artificial
  Mutation in BnaA.FAD2.a introduced by TALE nuclease pair BnFAD2_T01
caggatccatgtgtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcatctgggacatcatcatagcctcctgcttctactacgtcgccaccacttacttccctctcctccctcaccctctcccctacgccgccgccatcgtggctggcgatggccaccacctgctcctggcctctctactgggcctgccagggctgcgtcctaaccggcgtctgggtcatagcccacgagtgcggccaccacgccttcagcgactac

SEQ ID NO: 6512 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgctgccaccacgccttcagcgactac

SEQ ID NO: 6513 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccaagggtgcgtcctaaccggcgtcggggtcatagcccacgagtgcggccaccacgcctttagcgactac

SEQ ID NO: 6514 - DNA, 409 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcaaataatgattttattttgactgatagtgacctgttcgttgcaacaaattgatgagctctctactgggcctgccaagggtgcgtcctaaccggcgtctgggtcatagcccacgagtgcggccaccacgccttcagcgactac

SEQ ID NO: 6515 - DNA, 339 bp, Artificial
  Mutation in BnaA.FAD2.a introduced by TALE nuclease pair BnFAD2_T01
cagtatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgtttcaaacgctcgatccctcgctctttctcctacctcatctgggacatcatcatagcctcctgcttctactacgtcgccaccacttacttccctctcctccctcaccctctctcctacttactgggcctgccagggctgcgtcctaaccggcgtctgggtcatagccctcgagtgcggccaccacgccttcagcgactac

SEQ ID NO: 6516 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcctctgggtcatagcccacgagtgcggccaccacgccttcagcgactac

SEQ ID NO: 6517 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaacctccgaaaccgacaccatcaagcgcgtcccctgcgagacaccgcccttcactgtcggagaactcaagaaagcaatcccacctcactgtttcaaacgctcgatccctcgctctttctcctacctcatctgggacatcatcatagcctcctgcgcatactcccccgccaccactttcctccctctcctccctcaccctctctcccccgtcccctctactgggcctgccagggctgcgtcctaaccggcgtctgggtcatagcccacgagtgcggccaccacgccttcagcgactac

SEQ ID NO: 6518 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttgcctctctactgggcctgccagggctgcgtcctaaccggcgtctgggtcatagcccacgagtgcggccaccacgccttcagcgactac

SEQ ID NO: 6519 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagtgcggccaccacgccttcagcgacta

SEQ ID NO: 6520 - DNA, 356 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 6521 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttcgcctgggcctgccagggctgcgtcctaaccggcgtctgggtcatagcccacgagtgcggccaccacgccttcagcgactac

SEQ ID NO: 6522 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccagggctgcgtcctaaccggcgtctgggtcatagcccacgagtgcggccaccacgccttcagcgactac

SEQ ID NO: 6523 - DNA, 355 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcccctggcctctctactgggcctgccagggctgcgtcctaaccggcgtctgggtcatagcccacgagtgcggccaccacgccttcagcgactac

SEQ ID NO: 6524 - DNA, 349 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcggcctctctactgggcctgccaaggctgcgtcctaacgggcctctgggtcatagcccacgagtgcggccaccacgccttcagcgactac

SEQ ID NO: 6525 - DNA, 349 bp, Artificial
  Mutation in BnaA.FAD2.a introduced by TALE nuclease pair BnFAD2_T01
caggatccatgggtgcaggtggaagaatgcaagtgtctcctccccccaaaaagtctgaaaccgacaacctcaagcgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 6526 - DNA, 410 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcccccgccaccctccgggccgttgcttcacaacgttcaaatccgctcccggcggatttgtctggcctctctactgggcctgccagggctgcgtcctaaccggcgtctgggtcatagcccacgagtgcggccaccacgccttcagcgactac

SEQ ID NO: 6527 - DNA, 387 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccccggagcaggtggtggccatcgccagccacgatggcgcctggcctctctactgggcctgccagggctgcgtcctaaccggcgtctgggtcatagcccacgagtgcggccaccacgccttcagcgactac

SEQ ID NO: 6528 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacctgctggcctctctactgggcctgtcaagggtgcgtcctaaccggcgtctgggtcatagcccacgagtgcggccaccacgccttcagcgactac

SEQ ID NO: 6529 - DNA, 355 bp, Artificial
  Mutation in BnaA.FAD2.a introduced by TALE nuclease pair BnFAD2_T01
caggatccatgggtgcaggtggaagaatgcaagtgtctcctccctctaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgcccccacttccttccctctcctccctccccccctctcctactccgcgcctggcctctctactgggcctgccaagggtgcgtcctaaccggcgtctgggtcatagcccacgagtgcggccaccacgccttcagcgactac

SEQ ID NO: 6530 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtacactgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctactgggcctgccagggctgcgtcctaaccggcgtctgggtcatagcccacgagtgcggccaccacgccttcaacgactac

SEQ ID NO: 6531 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgtccttcactgtcggagaactcaagaaagcaatcccaccgcactgtttcaaacgctcgatccctcgctcgttctcctacctcatctgggacatcatcatagcctcctgcttctactacgtcgccaccacttacttccctctcctccctcaccctctctcctcccttggcctctctactgggcctgccaagggtgcgtcctaaccggcgtctgggtcatagcccacgagtgcggccaccacgccttcagcgactac

SEQ ID NO: 6532 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctactcctctctactgggcctgccagggctgcgtcctaaccggcgtctgggtcatagcccacgagtgcggccaccacgccttcagcgactac

SEQ ID NO: 6533 - DNA, 350 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 6534 - DNA, 348 bp, Artificial
  Mutation in BnaA.FAD2.a introduced by TALE nuclease pair BnFAD2_T01
caggatccatgggtgcaggtggaagaatgcaagtgtttcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccaacatggcctctctactgggcctgccaagggtgcgtcctaaccggcgtctgggtcatagcccacgagtgcggccaccacgccttcagcgactac

SEQ ID NO: 6535 - DNA, 334 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctgccaagggtgcgtcctaatcggcgtctgggtcatagcccacgagtgcggccaccacgccttcagcgactac

SEQ ID NO: 6536 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccgacttctctactgggcctgccaagggtgcgtcctaaccggcgtctgggtcatagcccacgagtgcggccaccacgccttcagcgactac

SEQ ID NO: 6537 - DNA, 344 bp, Artificial
  Mutation in BnaA.FAD2.a introduced by TALE nuclease pair BnFAD2_T01
caggatccatgggtgcaggttgaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggtcatcatcatagcctcctgcttctactacttcgccaccacttacttccctctcctccctcaccctctctcctcgcctctctactgggcctgccaagcgtgcttcctaacgggcctctgggtcatcgcccgcgaatgcggccaccacgccttcagcaactac

SEQ ID NO: 6538 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctggcacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 6539 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcataccctgcgagacaccgcccttcactgtcggagaactcaagaaagcaatcccaccgcactgtttcaaacgctcgatccctcgctctttctcctacctcatctgggacatcatcatctcctcctccctctaccacctctccacagcctacttccctctcctcccccaccctctcccgtatggcccctctactgggcctgccaaggctgcgtcctaacgggcctctgggtcatcgcccacgaatgcggccaccacgccttcagcgactac

SEQ ID NO: 6540 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgcttcaaacgctcgatccctcgctctttctcctacctcatctgggacatcatcatagcctcctgcttctactacgtcgccaccacttacttccctctcctccctcaccctctctcctacgactggcctctctactgggcctgccaagggtgcgtcctaaccggcgtctgggtcattgcccacgagtgcggccaccgcgccttcagcgactac

SEQ ID NO: 6541 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcacctagcctctctactgggcctgccagggctgcgtcctaaccggcgtctgggtcatagcccacgagtgcggccaccacgccttcagcgactac

SEQ ID NO: 6542 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgagtaccctgcgagacaccgcccttcactgtcggagaactcacgaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatcgcccacgaatgcggccaccacgccttcagcgactac

SEQ ID NO: 6543 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagggcggccaccacgccttcagcgactac

SEQ ID NO: 6544 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttggcctctctactgggcctgccagggctgcgtcctaaccgtcgtctgggtcatagcccacgagtgcggccaccacgccttcagcgactac

SEQ ID NO: 6545 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 6546 - DNA, 357 bp, Artificial
  Mutation in BnaA.FAD2.a introduced by TALE nuclease pair BnFAD2_T01
ccaggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 6547 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaccatcaaacgcgtaccctgcgagacaccgcccttcactgtcggagaactcaagaaagcaatcccaccgcactgtttcaaacgctcgatccctcgctctttctcctccctcatctgggacatcatcatagcctcctgcttctactacgtccccaccacctacttccctctcctccctccccctctctcctactcctggcccctctactgggcctgccaaggctgcgtcctaacgggcctctgggtcatcgcccacgaatgcggccaccacgccttcagcgactac

SEQ ID NO: 6548 - DNA, 334 bp, Artificial
  Mutation in BnaA.FAD2.a introduced by TALE nuclease pair BnFAD2_T01
caggatccatgggtgcaggtggaaggatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctgccaagggtgcgtcctaaccggcgtctgggtcatagcccacgagtgcggccaccacgccttcagcgactac

SEQ ID NO: 6549 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgcttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgac

SEQ ID NO: 6550 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgctggcctctctactgggcctgccagggctgcgtcctaacctgcgtctgggtcatagcccacgagggcggccgccacgccttcagcgactac

SEQ ID NO: 6551 - DNA, 323 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagggtgcgtcctaaccggcgtctgggtcatagcccacgagtgcggccaccacgccttcagcgactac

SEQ ID NO: 6552 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcaccgtttcaaacgctcgatccctcgctctttctcctacctcatctgggacatcatcatagcctcctgcttctactacgtcgccaccacttacttccctctcctccctcaccctctcgcccggcctctctactgggcctgccagggctgcgtcctaaccggcgtctgggtcatagcccacgagtgcggccaccacgccttcagcgactac

SEQ ID NO: 6553 - DNA, 349 bp, Artificial
  Mutation in BnaA.FAD2.a introduced by TALE nuclease pair BnFAD2_T01
caggatccatgggtgcaggtggaagaatgcaagtctctcccccctcaaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgctttggcctctctactgggcatgccatgacggcgtcttaaccggcctctgggtcttagcccgcgtgtgcggccgccgcgccttcaccgactac

SEQ ID NO: 6554 - DNA, 350 bp, Artificial
  Mutation in BnaA.FAD2.a introduced by TALE nuclease pair BnFAD2_T01
cgggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 6555 - DNA, 438 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttaatgtttaactttgttttagggcgactgccctgcggcgtaacatcgttgctggacagcatcgatatcgccgatctacgcacgctcgacctggcctctctactgggcctgccaagggtgcgtcctaaccggcgtctgggtcatagcccacgagtgcggccaccacgccttcagcgactac

SEQ ID NO: 6556 - DNA, 345 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccagggctgcgtcctaaccggcgtctgggtcatagcccacgagtgcggccaccacgccttcagcgactac

SEQ ID NO: 6557 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctggcctctctactgggcctgccagggctgcgtcctaaccggcgtctgggtcatagcccacgagtgcggccaccacgccttcagcgactac

SEQ ID NO: 6558 - DNA, 343 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaaccggcgtctgggtcatagcccacgagtgcggccaccacgccttcagcgactac

SEQ ID NO: 6559 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccactgcactgtttcaaacgctcgatccctcgctctttctcctacctcatctgtgacatcatcatagcctcctgcttctactacgtcgccaccacttacttccctctcctccctcaccctctctcctacttcggcctctctactgggcctgccaagggtgcgtcctaaccggcgtctgggtcatcgcccacgaatgcggccaccacgccttcagcgactac

SEQ ID NO: 6560 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgtggccaccacgccttcagcgactac

SEQ ID NO: 6561 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcttcctaaccggcgtctgggtcatagcccacgagtgcggccaccacgccttcagcgactac

SEQ ID NO: 6562 - DNA, 306 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctcaccctctctcctgcctctctactgggcctgccaagggtgcgtcctaaccggcgtctgggtcatagcccacgagtgcggccaccacgccttcagcgactac

SEQ ID NO: 6563 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctccttcggctctctactgggcctgccagggctgcgtcctaaccggcgtctgggtcatagcccacgagtgcggccaccacgccttcagcgactac

SEQ ID NO: 6564 - DNA, 325 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggctgcgtcctaaccggcgtctgggtcatagcccacgaatgcggccaccacgccttcagcgactac

SEQ ID NO: 6565 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctgcctggcctctctactgggcctgccaagggtgcgtcctaaccggcgtctgggtcatagcccacgagtgcggccaccacgccttcagcgactac

SEQ ID NO: 6566 - DNA, 349 bp, Artificial
  Mutation in BnaA.FAD2.a introduced by TALE nuclease pair BnFAD2_T01
caggatcctgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactactggcctctctactgggcctgccaagggtgcgtccgaaccggcgtctgggtcatagcccacgagtgcggccaccacgccttcagcgactac

SEQ ID NO: 6567 - DNA, 449 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgccaggcccgcggcttgaccccggagcaggtggtggccatcgccagcaatggcggtggcaagcaggcgctggagacggtccagcggctgttgccggtgctggcctctctactgggcctgccagggctgcgtcctaaccggcgtctgggtcatagcccacgagtgcggccaccacgccttcagcgactac

SEQ ID NO: 6568 - DNA, 344 bp, Artificial
  Mutation in BnaA.FAD2.a introduced by TALE nuclease pair BnFAD2_T01
caggatccatgagtgcaggtggaagaatgcaagtgtctcctccctccaagaagtatgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccggcctctctactgggcctgccagggctgcgtcctaaccggcgtctgggtcatagcccacgagtgctgccaccacgccatcagcgactac

SEQ ID NO: 6569 - DNA, 351 bp, Artificial
  Mutation in BnaA.FAD2.a introduced by TALE nuclease pair BnFAD2_T01
caggatccatgggtgcaggtgaaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctctatccctcgctctttctcctccctcatctgggccatcatcatagcctcctgcttctactacgtcgccaccagttacttccctctcctccctcaccctctctccgacggcgtggcctctctactgggcctgccagggctgcgtcctaaccggcgtctgggtcatagcccacgagtgcggccaccacgccttcagcgactac

SEQ ID NO: 6570 - DNA, 341 bp, Artificial
  Mutation in BnaA.FAD2.a introduced by TALE nuclease pair BnFAD2_T01
caggatccatgggtgcaggtggaagaatgcaagtctctcctccctccagctcccccggacccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttactgggcctgccagggctgcgtcctaaccggcgtctgggtcatagcccacgagtgcggccaccacgccttcagcgactac

SEQ ID NO: 6571 - DNA, 337 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctcaccctctctcctactcctctctactgggcctgccaagggtgcgtcctaacgggcctctgggtcatcgcccacgaatgcggccaccacgccatcagcaactac

SEQ ID NO: 6572 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgtgcctgccaagggtgcgtcctaaccggcgtctgggtcatagcccacgagtgcggccaccacgccttcagcgactac

SEQ ID NO: 6573 - DNA, 398 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccaccattcactctcggagacctcaagaaagcaatcccaccgcactgtttcaaactctcgatccctcgctctttctcctacctcatctgggacatcatcatagcctcctgcttctactacgtcgccaccacttacttccctctcctccctcaccctctctgccaacttctcaagattgcaaaacgtggcggcgtgaccgcagtggaggcagtgcatgcgcctctctactgggcctgccaagggtgcgtcctaaccggcgtctgggtcatagcccacgagtgcggccaccacgccttcagcgactac

SEQ ID NO: 6574 - DNA, 345 bp, Artificial
  Mutation in BnaA.FAD2.a introduced by TALE nuclease pair BnFAD2_T01
caggatccattggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccctggcctctctactgggcctgccaagggtgcgtcctaaccggcgtctgggtcatagcccacgagtgcggccaccacgccttcagcgactac

SEQ ID NO: 6575 - DNA, 331 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctacggggcctgccaagggtgcgtcctaaccggcctctgggtcatagcccacgagtgcggccaccacgccttcgcgactac

SEQ ID NO: 6576 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctctctactgggcctgccagggctgcgtcctaaccggcgtctgggtcatagcccacgagtgcggccaccacgccttcagcgactac

SEQ ID NO: 6577 - DNA, 341 bp, Artificial
  Mutation in BnaA.FAD2.a introduced by TALE nuclease pair BnFAD2_T01
ctggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttactgggcctgccagggctgcgtcctaaccggcgtctgggtcatagcccacgagtgcggccaccacgccttcagcgactac

SEQ ID NO: 6578 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttggcctctctactgggcctgccaagggtgcgtcctaaccggcgtcggggtcatagcccacgagtgcggccaccacgccttcagcgactac

SEQ ID NO: 6579 - DNA, 340 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccctactctactgggcctgccagggctgcgtcctaaccggcgtctgggtcatagcccacgagtgcggccaccacgccttcagcgactac

SEQ ID NO: 6580 - DNA, 431 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttttgccggtgctgggccaggcgcgcggtcgttcggctgcggcgagcggtatcagctcactcaaaggcggtaatacggttatcctggcctctctactgggcctgccagggctgcgtcctaacgggcgtctgggtcatagcccacgagtgcggccaccacgccatcagcgactac

SEQ ID NO: 6581 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctagccggcgtctgggtcatagcccgcgaatgcggccaccacgccttcagcgactac

SEQ ID NO: 6582 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacttcatcatagcctcctgcttctactacgtcgccaccacttacttccctctcctccctcaccctctctcctaccgccctagcctctctactgggcctgccagcgctgcgtcctaaccggcgtctgggtcatagcccacgagtgcggccaccacgccatcagcgactac

SEQ ID NO: 6583 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgtggcctctctactgggcctgccagggctgcgtcctaaccggcgtctgggtcatagcccacgagtgcggccaccacgccttcagcgactac

SEQ ID NO: 6584 - DNA, 386 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctagatccctcgctctttctcctacctcatctgggacatcatcatagcctcctgcttctactacgtcgccaccacttacttccctctcctccctcaccctctctcctacttggccaccacctgctggggggtcaagccgtgggcctggcacagtctctactgggcctgccagggctgcgtcctaaccggcgtctgggtcatagcccacgagtgcggccaccacgccttcagcgactac

SEQ ID NO: 6585 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcgtccaccacgccttcagcgactac

SEQ ID NO: 6586 - DNA, 438 bp, Artificial
  Mutation in BnaA.FAD2.a introduced by TALE nuclease pair BnFAD2_T01
caggatccatgggtacaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccagctgggccttgtagtggcccttgaagtggccggacacgaacaggaacttgaactcggtcacgctggaggggtacaccttccacctggcctctctactgggcctgccaagggtgcgtcctaaccggcgtctgggtcatagcccacgagggcggccaccacgccttcagcgactac

SEQ ID NO: 6587 - DNA, 350 bp, Artificial
  Mutation in BnaA.FAD2.a introduced by TALE nuclease pair BnFAD2_T01
caggatccatgggtgcaggtagaagaatgcaagtgtctcctccccccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgactgctggcctctctacggggcctgccagggctgcgtcctaacgggcctctgggtcatcgcccacgaatgcggccaccacgccttcagcgactac

SEQ ID NO: 6588 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaacgggcctctgggtcatcgcccacgaatgcggccaccacgccttcagcgactac

SEQ ID NO: 6589 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccgccacttacttccctcgcctccctccccctctctcctaccgctggcctctctactgggcctgccagggctgcgtcctaaccggcgtctgggtcatagcccacgagtgcggccaccacgccatcagcgactac

SEQ ID NO: 6590 - DNA, 349 bp, Artificial
  Mutation in BnaA.FAD2.a introduced by TALE nuclease pair BnFAD2_T01
caggatccatgggtgcaggtggaagaattcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 6591 - DNA, 355 bp, Artificial
  Mutation in BnaA.FAD2.a introduced by TALE nuclease pair BnFAD2_T01
caggatccatgggtgcaggtggaagaatgcaagtgtgtcccccctccaaaaagtctgaaaccgacaacatcaagcgcgtaccctgcgagacaccgcccttcactgtcggagaactcaagaaagcaatcccaccgcactgtttcaaacggtcgatccctcgctctttctcctacctcatctgggacatcatcatagcctcctgcttctactacgtcgccaccacttacttccctctcctccctcaccctctctcctacttcgcccctggcctctctactgggcctgccaagggtgcggccgaaccggcgtcggggttatagcccacgtgtgcggcctccacgccttcagcgactac

SEQ ID NO: 6592 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccagggctgcgtcctaaccggcgtctgggtcatagtccacgagtgcggccaccacgccttcagcgactac

SEQ ID NO: 6593 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctcaccggcgtctgggtcatagcccacgagtgcggccaccacgccttcagcgactac

SEQ ID NO: 6594 - DNA, 350 bp, Artificial
  Mutation in BnaA.FAD2.a introduced by TALE nuclease pair BnFAD2_T01
caggatccatggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtctgggtcatagcccacgagtgcggccaccacgccttcagcgactac

SEQ ID NO: 6595 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaattccaccgcactgtttcaaacgctcgatccctcgctctttctcctacctcatctgggacatcatcatagcctcctgcttctactacgtcgccaccacttacttccctctcctccctcaccctctctcctactctactgggcctgccaagggtgcgtcctaaccggcgtctgggtcatagcccacgagtgcggccaccacgccttcagcgactac

SEQ ID NO: 6596 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaaccggcgtctgggtcatagcccacgagtgcggccaccacgccttcagcgactac

SEQ ID NO: 6597 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacggcctctctactgggcctgccagggctgcgtcctaaccggcgtctgggtcatagcccacgagtgcggccaccacgccttcagcgactac

SEQ ID NO: 6598 - DNA, 355 bp, Artificial
  Mutation in BnaA.FAD2.a introduced by TALE nuclease pair BnFAD2_T01
caggatccatgggtgcaggtggaagaatgcaagtgtctcatccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccagggctgcgtcctaaccggcgtctgggtcatagcccgcgagtgcggccaccacgccttcagcgactac

SEQ ID NO: 6599 - DNA, 357 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccgcccgcctggcctctctactgggcctgccggggctgcgtcctaaccggcgtctgggtcatagcccacgagtgcggccaccacgccttcagcgactac

SEQ ID NO: 6600 - DNA, 342 bp, Artificial
  Mutation in BnaA.FAD2.a introduced by TALE nuclease pair BnFAD2_T01
caggatccatgggtgcaggcggaagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctactctctactgggcctgccagggctgcgtcctaaccggcgtctgggtcatagcccacgagtgcggccaccacgccttcagcgactac

SEQ ID NO: 6601 - DNA, 350 bp, Artificial
  Mutation in BnaA.FAD2.a introduced by TALE nuclease pair BnFAD2_T01
caggatccatgggtgcaggtggaagaatgcaagtctctcctcactccaagaagtctgaaaccgacaccatcaagcgcgtaccctgctagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 6602 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccactctcctacttcggcgggtctggcctctctactaggcctgccagggctgcgtcctaaccggcgtctgggtcatagcccacgagtgcggccaccacgccttcagcgactac

SEQ ID NO: 6603 - DNA, 343 bp, Artificial
  Mutation in BnaA.FAD2.a introduced by TALE nuclease pair BnFAD2_T01
caggatccagggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctagatccctcgctctttctcctacctcatctgggacatcatcatagcctcctgcttctactacgtcgccaccacttacttccctctcctccctcaccctctctcctagcctctctactgggcctgccagggctgcgtcctaaccggcgtctgggtcatagcccacgagtgcggccaccacgccttcagcgactac

SEQ ID NO: 6604 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccatgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaaccggcgtctgggtcatagcccacgagtgcggccaccacgccttcagcgactac

SEQ ID NO: 6605 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacacccccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactcctctctactgggcctgccagggctgcgtcctaacgggcctctgggtcatcgcccacgaatgcggccaccacgccttcagcgactac

SEQ ID NO: 6606 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctagatccctcgctctttctcctacctcatctgggacatcatcatagcctcctgcttctactacgtcgccaccacttacttccctctcctccctcaccctctctcccacggcctctctactgggcctgccagggctgcgtcctaaccggcgtctgggtcatagcccacgagtgcggccaccacgccttcagcgactac

SEQ ID NO: 6607 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccaaggctgcgtcctaacgggcctcggggtcatagcccacgagtgcggccaccacgccttcaacgactac

SEQ ID NO: 6608 - DNA, 335 bp, Artificial
  Mutation in BnaA.FAD2.a introduced by TALE nuclease pair BnFAD2_T01
caggatccatgggtgcaggcggaagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaactggcctctgggtcatagcccacgtgtgcggccttcacgcctgcagcgactac

SEQ ID NO: 6609 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctaacctggcctctctactgggcctgccaagggtgcgtcctaacgggcctctgggtcatcgcccacgaatgcggccaccacgccttcagcgactac

SEQ ID NO: 6610 - DNA, 348 bp, Artificial
  Mutation in BnaA.FAD2.a introduced by TALE nuclease pair BnFAD2_T01
caggatccatgggtgcagcaggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 6611 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgatacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttactgggcctgccagggctgcgtcctaaccggcgtctgggtcatagcccacgagtgcggccaccacgccttcagcgactac

SEQ ID NO: 6612 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaatggcctctctactgggccggccagggctgcgtcctaaccggcgtcggggtcatagcccacgagtgcggccaccacgccttcagcgactac

SEQ ID NO: 6613 - DNA, 350 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttttggcctctctactgggcctgccagggctgcgtcctaaccggcgtctgggtcatagcccacgagtgcggccaccacgccttcagcgactac

SEQ ID NO: 6614 - DNA, 349 bp, Artificial
  Mutation in BnaA.FAD2.a introduced by TALE nuclease pair BnFAD2_T01
caggatccatgggtgcagggggaagaatgcaagtgtgtcctccctcaaaaaagtctgaaaccgacaacatcaagcgcgtaccctgcgagacaccgcccttcactgtcggataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgttggcctctctactgggcctgccaagggtgcgtcctaaccggcgtctgggtcatagcccgcgagtgcggcgaccacgccatcagcgactac

SEQ ID NO: 6615 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttctctctactgggcctgccagggctgcgtcctaaccggcgtctgggtcatagcccacgagtgcggccaccacgccttcagcgactac

SEQ ID NO: 6616 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatcgcccacgagtgcggccaccacgccttcagcgactac

SEQ ID NO: 6617 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctggaacatcatcatagcctcctgcttctactacgtcgccaccacttacttccctctcctccctcaccctctctccgcctggcctctctactgggcctgccagggctgcgtcctaaccggcgtctgggtcatagcccacgagtgcggccaccacgccttcagcgactac

SEQ ID NO: 6618 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggcctgccagggctgcgtcctaacgggcgtctgggtcatagcccacgagtgcggccaccacgccttcagcgactac

SEQ ID NO: 6619 - DNA, 339 bp, Artificial
  Mutation in BnaA.FAD2.a introduced by TALE nuclease pair BnFAD2_T01
caggatccatgggtgcaggtggaagaatgcaagtctctcatccctccagctcccccggaaccaacaccctcaaacgcgtcccccgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttactgggcctgccagggctgcgtcctaaccggcgtctgggtcatagcccacgagtgcggcctccacgccttcagcgactac

SEQ ID NO: 6620 - DNA, 348 bp, Artificial
  Mutation in BnaA.FAD2.a introduced by TALE nuclease pair BnFAD2_T01
caggatccatgggtgcaggtggaagaatgcaagtacctccaccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccgcgagtgcggcctccacgccttcagcgactac

SEQ ID NO: 6621 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcctctctactgggcctgccagggctgcgtcctaacgggcctctgggtcatagcccacgagtgcggccaccacgccttcagcgactac

SEQ ID NO: 6622 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctacgtctggcctctctactgggcctgccagggctgcgtcctaaccggcgtctgggtcatagcccacgagtgcggccaccacgccttcagcgactac

SEQ ID NO: 6623 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttccgcgcggcctctctactgggcctgccaggggtgcgtcctaaccggcgtctgggtcatagcccacgagtgcggccaccacgccttcagcgactac

SEQ ID NO: 6624 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttctgcctctctactgggcctgccaaggctgcgtcctaacgggcctctgggtcatcgcccacgaatgcggccaccacgccttcagcgactac

SEQ ID NO: 6625 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaaggctgcgtcctaacgggcctctgggtcatcgcccacgaatgcggccaccacgccttcagcgactac

SEQ ID NO: 6626 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatggcccacgagtgcggccaccacgccttcagcgactac

SEQ ID NO: 6627 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctacgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 6628 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcgaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 6629 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccaaggctgcgtcctaacgggcctctgggtcatagcccacgagtgcggccaccacgccttcagcgactac

SEQ ID NO: 6630 - DNA, 346 bp, Artificial
  Mutation in BnaA.FAD2.a introduced by TALE nuclease pair BnFAD2_T01
caggatctgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggtctctctactgggcctgccagggctgcgtcctaaccggcgtctgggtcatagcccacgagtgcggccaccacgccttcagcgactac

SEQ ID NO: 6631 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccacaacttacttccctctcctccctcaccctctctcctactcctggcctctctactgggcctgccaaggctgcgtcctaacgggcctctgggtcatagcccacgagtgcggccaccacgccttcagcgactac

SEQ ID NO: 6632 - DNA, 471 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttgcttttttataaggccaactttgtacaaaaaagcaggcttaggtaccgcgcgaatgcacctagatccaatgatcatgagcggagaatgggcctggcacagcaccggcaacagccgctggacctggcctctctactgggcctgccagggctgcgtcctaaccggcgtctgggtcatagcccacgagtgcggccaccacgccttcagcgactac

SEQ ID NO: 6633 - DNA, 351 bp, Artificial
  Mutation in BnaA.FAD2.a introduced by TALE nuclease pair BnFAD2_T01
caggaaccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacaacatcatagcctcctgcttctactacgtcgccaccacttacttccctctcctccctcaccctctctcctacttcctggcctctctactgggcctgccagggctgcgtcctaaccggcgtctgggtcatagcccacgagtgcggccaccacgccttcagcgactac

SEQ ID NO: 6634 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccaagggtgcgtcctaaccggcggctgggtcatagcccacgagtgcggccaccacgccttcagcgactac

SEQ ID NO: 6635 - DNA, 430 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttatgtacggccagcaacgtcggttcgagatggcgctcgatgacgccaacgatggccaccacctgctccggggtcaagccagttggcctctctactgggcctgccagggctgcgtcctaaccggcgtctgggtcatagcccacgagtgcggccaccacgccttcagcgactac

SEQ ID NO: 6636 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcacgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 6637 - DNA, 300 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccaagggtgcgtcctaacgggcctctgggtcatagcccgcgagtgcggccaccgcgccttcagcgactac

SEQ ID NO: 6638 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccgcagcgactac

SEQ ID NO: 6639 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcccaaccggcgtctgggtcatagcccacgagtgcggccaccacgccttcagcgactac

SEQ ID NO: 6640 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccacactgtttcaaacgctcgatccctcgctctttctcctacctcatctgggacatcatcatagcctcctgcttctactacgtcgccaccacttacttccctctcccccctcaccctctctcctacttcggcctctctactgggcctgccagggctgcgtcctaaccggcgtctgggtcatagcccacgagtgcggccaccacgccttcagcgactac

SEQ ID NO: 6641 - DNA, 346 bp, Artificial
  Mutation in BnaA.FAD2.a introduced by TALE nuclease pair BnFAD2_T01
caggatccatgggtgcaggcggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaacgggcctctgggtcatcgcccacgaatgcggccaccacgccttcagcgactac

SEQ ID NO: 6642 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcaagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgctggcctctctactgggcctgccagggctgcgtcctaaccggcgtctgggtcatagcccacgagtgcggccaccacgccttcagcgactac

SEQ ID NO: 6643 - DNA, 335 bp, Artificial
  Mutation in BnaA.FAD2.a introduced by TALE nuclease pair BnFAD2_T01
caggatccatgggtgcaggtggaagaatgcaagtgtctcctcaatccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgcggccaccacgccttcagcgactac

SEQ ID NO: 6644 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccactaacttccctctcctccctcaccctctctccgactacgctggcctctctactgggcctgccaaggctgcgtcctaacgggcctctgggtcatagcccacgagtgcggccaccacgccttcagcgactac

SEQ ID NO: 6645 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactgc

SEQ ID NO: 6646 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctctctactgggcctgccaagggtgcgtcctaaccggcgtctgggtcatagcccacgagtgcggccaccacgccttcagcgactac

SEQ ID NO: 6647 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaaccggcgtctgggtcatagcccacgagtgcggccaccacgcctgcagcgactac

SEQ ID NO: 6648 - DNA, 410 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttccccgccaccctccgggccgttgcttcacaacgttcaaatccgctcccggcggatttgtctggcctctctactgggcctgccagggctgcgtcctaaccggcgtctgggtcatagcccacgagtgcggccaccacgccttcagcgactac

SEQ ID NO: 6649 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtgcgcctggcctctctactgggcctgccagggctgcgtcctaaccggcgtctgggtcatagcccacgagtgcggcctccacgccttcagcgactac

SEQ ID NO: 6650 - DNA, 344 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgggcctgccagggctgcgtcctaaccggcgtctgggtcatagcccacgagtgcggccaccacgccttcagcgactac

SEQ ID NO: 6651 - DNA, 339 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggcctgccagggctgcgtcctaaccggcgtctgggtcatagcccacgagtgcggccaccacgccttcagcgactac

SEQ ID NO: 6652 - DNA, 345 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccagggctgcgtcctaaccggcgtctgggtcatagcccacgagtgcggccaccacgccttcagcgactac

SEQ ID NO: 6653 - DNA, 357 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcgcctggcctctctactgggcctgccagggctgcgtcctaaccggcgtctgggtcatagcccacgagtgcggccaccacgccttcagcgactac

SEQ ID NO: 6654 - DNA, 337 bp, Artificial
  Mutation in BnaA.FAD2.a introduced by TALE nuclease pair BnFAD2_T01
caggatccatgggtgcaggaggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacactgggcctgccaagggtgcgtcctaaccggcgtctgggtcatagcccacgagtgcggccaccacgccttcatcgactac

SEQ ID NO: 6655 - DNA, 344 bp, Artificial
  Mutation in BnaA.FAD2.a introduced by TALE nuclease pair BnFAD2_T01
caggatccatgggtgcaggtggaagaatgcaagtctctactccctccagctcccccggaaccaacaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccagggctgcgtcctaacgggcctctgggtcatagcccacgagtgcggccaccacgccttcagcgactac

SEQ ID NO: 6656 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccagggctgcgtcctaaccggcgtctgggtcatcgcccacgaatgcggccaccacgccttcagcgactac

SEQ ID NO: 6657 - DNA, 354 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttggcctctctactgggcctgccagggctgcgtcctaaccggcgtctgggtcatagcccacgagtgcggccaccacgccttcagcgactac

SEQ ID NO: 6658 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgtccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 6659 - DNA, 348 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccggcaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 6660 - DNA, 349 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgctctgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 6661 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccagggctgcgtcctaacgggcctctgggtcatagcccacgagtgcggccaccacgccttcagcgactac

SEQ ID NO: 6662 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaaccggcctctgggtcatcgcccacgaatgcggccaccacgccttcagcgactac

SEQ ID NO: 6663 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 6664 - DNA, 329 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgtttcaaacgctcgatccctcgctctttctcctacctcatctgcgacatcatcatatcctcctgcttctactacctcgccaccacttacttccctctcctccctcaccctctctgggcctgccaaggctgcgtcctaacgggcgtctgggtcatagcccacgagtgcggccaccacgccttcagcgactac

SEQ ID NO: 6665 - DNA, 329 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaattccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaaccggcgtctgggtcatagcccacgagtgcggccaccacgccttcagcgactac

SEQ ID NO: 6666 - DNA, 347 bp, Artificial
  Mutation in BnaA.FAD2.a introduced by TALE nuclease pair BnFAD2_T01
caggatccatgggtgcagggggaagaatgcaagtggctcctccctcaaaaaagtctgaaaccgacaacatcaagcgcgtaccctgcgagacaccgcccttcactgtcggagaactcaagaaagcaatcccaccgcactgtttcaaacgctcgatccctcgatctttctcctacctcatctgggacatcatcatagcctccggcttctactacgtcgccaccacttacttccctctcctccctcaccctctctccaactggcctctctactgggcctgccaagggtgcgtcctaaccggcgtctgggtcatagcccacgagtgctgccgccacgccgtcagcgactac

SEQ ID NO: 6667 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctcggacatcatcatagcctcctgcttctacttcgtcgccaccacttacttccctctcctccctcaccctctcccctgcctctctactgggcctgccagggctgcgtcctaaccggcgtctgggtcatagcccacgagggcggccaccacgccttcagcgactac

SEQ ID NO: 6668 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtcctaaccggcgtctgggtcatagcccacgagtgcggccaccacgccatcagcgactac

SEQ ID NO: 6669 - DNA, 349 bp, Artificial
  Mutation in BnaA.FAD2.a introduced by TALE nuclease pair BnFAD2_T01
caggatccatgggtgcaggtggaagaatacaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttcccctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcgtccaccacgccttcagcgactac

SEQ ID NO: 6670 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccctcaccctctctactgggcctgccagggctgcgtcctaaccggcgtctgggtcatagcccacgagtgcggccaccacgccttcagcgactac

SEQ ID NO: 6671 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcgtctctctactgggcctgccaagggtgcgtcctaaccggcgtctgggtcatagcccacgagtgcggccaccacgccttcagcgactac

SEQ ID NO: 6672 - DNA, 354 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttggcctctctactgggcctgccagggctgcgtcctaaccggcgtctgggtcatagcccacgagtgcggccaccacgccttcagcgactac

SEQ ID NO: 6673 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccctcgcctgggcctgccagggctgcgtcctaaccggcgtctgggtcatagcccacgagtgcggccaccacgccttcagcgactac

SEQ ID NO: 6674 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctagctctttctcctacctcatctgggacatcatcatagcctcctgcttctactacgtcgccaccacttacttccctctcctccctcaccctctctcctatggcctctctactgggcctgccagggctgcgtcctaaccggcgtctgggtcatagcccacgagtgcggccaccacgccttcagcgactac

SEQ ID NO: 6675 - DNA, 352 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccacttcgcctggcctctctactgggcctgccagggctgcgtcctaaccggcctctgggtcatagcccacgagtgcggccaccacgccttcagcgactac

SEQ ID NO: 6676 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctagcctctctactggacctgccaagggtgcgtcctaaccggcgtctgggtcatagcccacgagtgcggccaccacgccttcagcgactac

SEQ ID NO: 6677 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccagggctgcgtcctaaccggcgtctgggacatagcccacgagtgcggccaccacgccttcagcgactac

SEQ ID NO: 6678 - DNA, 387 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccccggagcaggtggtggccatcgccagccacgatggcgcctggcctctctactgggcctgccagggctgcgtcctaaccggcgtctgggtcatagcccacgagtgcggccaccacgccttcagcgactac

SEQ ID NO: 6679 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcggcctaaccggcgtctgggtcatagcccacgagtgcggccaccacgccttcagcgactac

SEQ ID NO: 6680 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccagggctgcgtcctaaccggcgtctgtgtcatagcccacgagtgcggccaccacgccttcagcgactac

SEQ ID NO: 6681 - DNA, 417 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtcaggacatgatcgcagcgttgccagagcgagagtctccgcgctgtagaagtcaccattgttgtgctggcctctctactgggcctgccagggctgcgtcctaaccggcgtctgggtcatagcccacgagtgcggccaccacgccttcagcgactac

SEQ ID NO: 6682 - DNA, 347 bp, Artificial
  Mutation in BnaA.FAD2.a introduced by TALE nuclease pair BnFAD2_T01
caggatccatgggtggcaggtggaagaatgcaagtctctcctacctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 6683 - DNA, 378 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctccagcgcctgcttgccgccatcgtggctggcgatggccaccacctgctccggggtcaagccgtgagggctgggtcatagcccacgagggcggccactacgccttcagcgactac

SEQ ID NO: 6684 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctcccgggcctgccaagggtgcgtcctaaccggcctctgggtcatagcccacgagtgcggccaccacgccttcagcgactac

SEQ ID NO: 6685 - DNA, 344 bp, Artificial
  Mutation in BnaA.FAD2.a introduced by TALE nuclease pair BnFAD2_T01
caggatccatgggtgcaggtagaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccggcctctctactgggcctgccagggctgcgtcctaaccggcgtctgggtcatagcccacgagtgcggccaccacgccttcagcgactac

SEQ ID NO: 6686 - DNA, 331 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgggcctgccagggctgcgtcctaacgggcctctgggtcatcgcccacgaatgcggccaccacgccttcagcgactac

SEQ ID NO: 6687 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctaccgggcctgccagggctgcgtcctaaccggcgtctgggtcatagcccacgagtgcggccaccacgcctgcagcgactac

SEQ ID NO: 6688 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccctacccctggcccctctactgggcctgccaaggctgcgtcctaacgggcctctgggtcatagcccacgagtgcggccaccacgccttcagcgactac

SEQ ID NO: 6689 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccaacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccactcgcctctctactgggcctgccaagggtgcgtcctaaccggcgtctgggtcatagcccacgagtgcggccaccacgccttcagcgactac

SEQ ID NO: 6690 - DNA, 329 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgccaagggtgcgtcctaaccggcctctgggtcatcgcccacgaatgcggccaccacgccttcagcgactac

SEQ ID NO: 6691 - DNA, 387 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgccatcgtggctggcgatggccaccacctgctcctggcctctctactgggcctgccaagggtgcgtcctaacgggcctctgggtcatcgcccacgaatgcggccaccacgccttcagcgactac

SEQ ID NO: 6692 - DNA, 335 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctggtacatcatcatagcctcctgcttctactacgtcgccaccacttacttccctctcctccctcaccctctcccctacttagcctgccaagcgtgcgtcctaaccggcgtctgggtcatagcccacgagtgcggccaccacgccttcagcgactac

SEQ ID NO: 6693 - DNA, 349 bp, Artificial
  Mutation in BnaA.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgttggcctctctactgggcctgccagggctgcgtcctaaccggcgtctgggtcatagcccacgagtgcggccaccacgccatcagcgactac

SEQ ID NO: 6694 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatggcctctctactgggcctgccagggctgcgtcctaaccggcgtctgggtcatagcccacgagtgcggccaccacgccttcagcgactac

SEQ ID NO: 6695 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccagggctgcgtcctaacgggcctctgggtcatagcccacgagtgcggccaccacgccttcagcgactac

SEQ ID NO: 6696 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacaggcctctctactgggcctgccagggctgcgtcctaacgggcctctgggtcatcgcccacgaatgcggccaccacgccttcagcgactac

SEQ ID NO: 6697 - DNA, 354 bp, Artificial
  Mutation in BnaA.FAD2.a introduced by TALE nuclease pair BnFAD2_T01
caggatccatgggtgcaggtggaagaatgcaagtgtctccttcctccaaaaagtctgaaaccgacaacatcaagcgcgtaccctgcgagacaccgcccttcactgtcggagaactcaagaaagcaaacccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggtctgccaagggtgcgtcctaacgggcctctgggtcatcgcccacgaatgcggccaccacgccttcagcgactac

SEQ ID NO: 6698 - DNA, 351 bp, Artificial
  Mutation in BnaA.FAD2.a introduced by TALE nuclease pair BnFAD2_T01
caggatccatgagtgcaggtggaagaatgcaagtgtctcctaactccaaaaagtctgaaaccgacaacatcaagcgcgtaccctgcgagacaccgcccttcactgtcggagaactcaagaaagcaatcccaccccactgtttcaaacgctcgatccctcgctctttctcctacctcatctgggacatcatcatagcctcctgcttctactacgtcgccaccacttacttccctctcctccctcaccctctctcctacttcgcctggcctctactgggcctgccaagggtgcgtcctaaccggcgtctgggtcatagcccacgagtgcggccaccacgccttcagcgactac

SEQ ID NO: 6699 - DNA, 332 bp, Artificial
  Mutation in BnaA.FAD2.a introduced by TALE nuclease pair BnFAD2_T01
caggatccatgggtgcaggtggaagaatgcaagtgtgtcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccagggctgcgtcctaacgggcctctgggtcatagcccacgagtgcggccaccgcgccttcagcgactac

SEQ ID NO: 6700 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccatctctcctatcctctctactgggcctgccagggctgcgtcataaccggcgtctgggtcatagcccacgagtgcggccaccacgccttcagcgactac

SEQ ID NO: 6701 - DNA, 348 bp, Artificial
  Mutation in BnaA.FAD2.a introduced by TALE nuclease pair BnFAD2_T01
caggatccatgggtgcaggaggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 6702 - DNA, 434 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcggctgttgccggtgctgtgccaggcccacggcttgaccccccagcaggtggtggccatcgccagcaatggcggtggcaagcaggcgctggaggcctggcctctctactgggcctgccagggctgcgtcctaaccggcgtctgggtcatagcccacgagtgcggccaccacgccttcagcgactac

SEQ ID NO: 6703 - DNA, 349 bp, Artificial
  Mutation in BnaA.FAD2.a introduced by TALE nuclease pair BnFAD2_T01
caggatccatgggtgcaggtggaagaatgcaagtctctcctccctccagcccccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctgggtcattgcccacgagtgcggccaccacgccttcagcgactac

SEQ ID NO: 6704 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccaagggtgcgtcctaaccggcgtctgggtcatagcccacgagtgcggccaccacgccttcagcgactac

SEQ ID NO: 6705 - DNA, 351 bp, Artificial
  Mutation in BnaA.FAD2.a introduced by TALE nuclease pair BnFAD2_T01
caggatccatgggtgcaggtggaagaatgcaagtgtctcctccctacaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtctgggtcatagcccacgagtgcggccaccacgccttcagcgactac

SEQ ID NO: 6706 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccagggctgcgtcctaaccggcgtctgggtaatagcccacgagtgcggccaccacgccttcagcgactac

SEQ ID NO: 6707 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctttcctggcctctctactgggcctgccagggctgcgtcctaaccggcgtctgggtcatagcccacgagtgcggccaccacgccttcagcgactac

SEQ ID NO: 6708 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggccggccaagggtgcgtcctaaccggcgtctgggtcatagcccacgagtgcggccgccacgccttcagcgactac

SEQ ID NO: 6709 - DNA, 389 bp, Artificial
  Mutation in BnaA.FAD2.a introduced by TALE nuclease pair BnFAD2_T01
caggatccatgggtgcaggtggaagaatgcaagtgtctcctccctccaaaaagtctgaacccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccacccacgtataaaccgtcgatgccctgctgaatattgaactgaaccaggcgactggcctctctactgggcctgccaagggtgcgtcctaaccggcgtctgggtcatagcccacgagtgcggccaccacgccttcagcgactac

SEQ ID NO: 6710 - DNA, 351 bp, Artificial
  Mutation in BnaA.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcctggcctctctactgggcctgccagggctgcgtcctaacgggcctctgggtcatcgcccacgaatgcggccaccacgccttcagcgactac

SEQ ID NO: 6711 - DNA, 348 bp, Artificial
  Mutation in BnaA.FAD2.a introduced by TALE nuclease pair BnFAD2_T01
caggatccatgggtgcaggtggaagaatgcaagtgtctcctccctcccaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 6712 - DNA, 277 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttcacgccttcagcgactac

SEQ ID NO: 6713 - DNA, 348 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtgtgggtcatagcccacgagtgcggccaccacgccttcagcgaac

SEQ ID NO: 6714 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcctctctactgggcctgccagggctgcgtcctaaccggcgtctgggtcatagcccacgagtgcggccaccacgccttcagcgactac

SEQ ID NO: 6715 - DNA, 350 bp, Artificial
  Mutation in BnaA.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 6716 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccgcctggcccctctactgggcctgccaaggctgcgtcctaaccggcctctgggtcatagcccacgagtgctgccaccacgccttcagcgactac

SEQ ID NO: 6717 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgcctctctactgggcctgccagggctgcgtcctaaccggcgtctgggtcatagcccacgagtgcggccaccacgccttcagcgactac

SEQ ID NO: 6718 - DNA, 414 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccggcaaaatcgcgccgaaggatgtcgctgccgactgggcaatggagcgcctgccggcccacctggcctctctactgggcctgccaagggtgcgtcctaacgggcctctgggtcatcgcccacgaatgcggccaccacgccttcagcgactac

SEQ ID NO: 6719 - DNA, 312 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctagctctttctcctacctcatctgggacatcatcatagcctcctgcttctactacgtcgccaccacttacttacctctcctccctcaccctgtgcgtcctaaccggcgtctgggtcatagcccacgagtgcggccaccacgccttcagcgactac

SEQ ID NO: 6720 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactcgcctctctactgggcctgccatggctgcgtcctaaccggcgtctgggtcatagcccacgagtgcggccaccacgccttcagcgactac

SEQ ID NO: 6721 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgggcctctctactgggcctgccagggctgcgtcctaaccggcgtctgggtcatagcccacgagtgcggccaccacgccttcagcgactac

SEQ ID NO: 6722 - DNA, 385 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccgtggccctgccacagccccgccaacagccgctggaccgtctccagcgcctgcctggcctctctactgggcctgccaagggtgcgtcctaaccggcgtctgggtcatagcccacgagtgcggccaccacgccttcagcgactac

SEQ ID NO: 6723 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaagggggcgtcctaaccggcgtctgggtcatagcccacgagtgcggccaccacgccttcagcgactac

SEQ ID NO: 6724 - DNA, 313 bp, Artificial
  Mutation in BnaA.FAD2.a introduced by TALE nuclease pair BnFAD2_T01
caggatccatgggtggcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 6725 - DNA, 339 bp, Artificial
  Mutation in BnaA.FAD2.a introduced by TALE nuclease pair BnFAD2_T01
caggatccatgggtgcaggtggaagaatgcaagtgtctcctccttccaagaagtctgaaaccgacaacatcaagcgcgtaccctgcgagacaccgcccttcactgtcggagaactcaagaaagcaatcccaccgcactgtttcaaacgctcgatccctcgctctttctcctaactcatctgggacatcatcatagcctcctgcttctactacgtcgccaccacttacttccctctcctccctcaccctctctcctctctactgggcctgccagggctgcgtcctaaccggcgtctgggtcatagcccacgagtgcggccaccacgccttcagcgactac

SEQ ID NO: 6726 - DNA, 357 bp, Artificial
  Mutation in BnaA.FAD2.a introduced by TALE nuclease pair BnFAD2_T01
caggatccatgggtgcaggtggaagaatgcaagtgtctcctccccccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggtgcctcgcctctctactgggcctgccaagggtgccgcctaaccggcggctgggtcatagcccacgagtgcggccagcacgccttcagcgactac

SEQ ID NO: 6727 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtctggcctctcttctgggccggccagggctgcgtcctaaccggcgtcggggtcatagcccacgaatgcggccaccacgccttcagcgactac

SEQ ID NO: 6728 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 6729 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagccccctgcttctactacgtcgccaccacttacttccctctcctccctcaccctctctcctacttcgccgcctggcctctctactgggcctgccagggctgcgtcctaaccggcgtctgggtcatagcccacgagtgcggccaccacgccttcagcgactac

SEQ ID NO: 6730 - DNA, 348 bp, Artificial
  Mutation in BnaA.FAD2.a introduced by TALE nuclease pair BnFAD2_T01
caggatccatgggtgcaggtggaagaatgcaagtgtctaatccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 6731 - DNA, 350 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagggcggccaccacgccttcagcgactac

SEQ ID NO: 6732 - DNA, 337 bp, Artificial
  Mutation in BnaA.FAD2.a introduced by TALE nuclease pair BnFAD2_T01
cagatccatgggtgcaggtggaagaatgcaagtgtctcctccctcccaaaagtctgaaaccgacaacctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcctgccaagggtgcgtcctaaccggcgtctgggtcatagcccacgagtgcggccaccacgccttcagcgactac

SEQ ID NO: 6733 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgctggcctctctactgggcctgccagggcggcgtcctaaccggcgtcggggtcatagcccacgagggcggccaccacgcctgcagcgactac

SEQ ID NO: 6734 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatccctcgctctttctcctacctcatctgggacatcatcatagcctcctgcctctactacgtcgccaccacttacttccctctcctccctcaccctctctcccacctggcctctctactgggcctgccagggctgcgtcctaaccggcgtctgggtcatagcccacgagtgcggccaccacgccttcagcgactac

SEQ ID NO: 6735 - DNA, 349 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccagggctgcgtcctaaccggcgtctgggtcatagcccacgagtgcggccaccacgccttcatcgactac

SEQ ID NO: 6736 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggccggccagggctgcgtcctaaccggcgtctgggtcatagcccacgagtgcggccaccacgccttcagcgactac

SEQ ID NO: 6737 - DNA, 343 bp, Artificial
  Mutation in BnaA.FAD2.a introduced by TALE nuclease pair BnFAD2_T01
caggatccattggtgcaggtgcaagaatgcaagtgtctcctccctccaaaaagtctgaaaccgacaacatcgagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaaccggcgtctgggtcatagcccacgagtgcggccaccacgccttcagcgactac

SEQ ID NO: 6738 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccagggctgcgtcctaaccggcgtctggatcatagcccacgagtgcggccaccacgccttcagcgactac

SEQ ID NO: 6739 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctgccaagggtgcgtcctaacgggcctctgggtcatagcccacgagtgcggccaccacgccttcagcgactac

SEQ ID NO: 6740 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctggttcatagcccacgagtgcggccaccacgccttcagcgactac

SEQ ID NO: 6741 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcccctgcttctactacgtcgccaccacttacttccctctcctccctcaccctctctcctacgcctctctactgggcctgccagggctgcgtcctaaccggcgtctgggtcatagcccacgagtgcggccaccacgccttcagcgactac

SEQ ID NO: 6742 - DNA, 348 bp, Artificial
  Mutation in BnaA.FAD2.a introduced by TALE nuclease pair BnFAD2_T01
caggatccatgggtgcagggggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcagagcccacgagtgcggccaccacgccttcagcgactac

SEQ ID NO: 6743 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctctactgggcctgccaaggctgcgtcctaaccggcgtctgggtcatagcccacgagtgcggccaccacgccttcagcgactac

SEQ ID NO: 6744 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactccgcccgcctggcctctctactgggcctgccagggctgcgtcctaaccggcgtctgggtcatagcccacgagtgcggccaccacgccttcagcgactac

SEQ ID NO: 6745 - DNA, 380 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacagtggtccggcgcacgcgctctggaggcctgcctctctactgggcctgccaagggtgcgtcctaaccggcgtctgggtcatagcccacgagtgcggccaccacgccttcagcgactac

SEQ ID NO: 6746 - DNA, 347 bp, Artificial
  Mutation in BnaA.FAD2.a introduced by TALE nuclease pair BnFAD2_T01
caggatccatgtgtgcagctgcaagaatgcaagtgtctcctctatccaaaaagtctgaacccgacaacaaccagcgcgtaccctgcgagacaccgcccttcactgtctgagaactcaagaaagcaatcccaccgcactgtttcaaaccctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcagagcccacgagtgcggccaccacgccttcagcgactac

SEQ ID NO: 6747 - DNA, 348 bp, Artificial
  Mutation in BnaA.FAD2.a introduced by TALE nuclease pair BnFAD2_T01
caggatccatgggtgcaggtggaagaatgcaagtgtctcctacctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 6748 - DNA, 345 bp, Artificial
  Mutation in BnaA.FAD2.a introduced by TALE nuclease pair BnFAD2_T01
caggatccatgggtgcaggtgcaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcggctctctactgggcctgccaagggggcgtgctaaccggcggctgggtcatagcccacgattgcggccaccacgcctgtagcgactac

SEQ ID NO: 6749 - DNA, 352 bp, Artificial
  Mutation in BnaA.FAD2.a introduced by TALE nuclease pair BnFAD2_T01
caggatccatgtgtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccagggctgcgtcctaaccggcgtctgggtcatagcccacgagtgcggccaccacgccttcagcgactac

SEQ ID NO: 6750 - DNA, 346 bp, Artificial
  Mutation in BnaA.FAD2.a introduced by TALE nuclease pair BnFAD2_T01
taggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaacgggcctctgggtcatcgcccacgaatgcggccaccacgccttcagcgactac

SEQ ID NO: 6751 - DNA, 345 bp, Artificial
  Mutation in BnaA.FAD2.a introduced by TALE nuclease pair BnFAD2_T01
caggatccatgggtgcaggtggaagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgccttcagcgactac

SEQ ID NO: 6752 - DNA, 398 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgccttggcaacgctgcgatcatggcctgatacttgacagcgacggtccctggcctctctactgggcctgccaagggtgcgtcctaaccggcgtctgggtcatagcccacgagtgcggccaccacgccttcagcgactac

SEQ ID NO: 6753 - DNA, 335 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacacaatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgtgtcctaaccggcgtctgggtcatagcccacgagtgcggccaccacgccttcagcgactac

SEQ ID NO: 6754 - DNA, 350 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 6755 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaatcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaagggtgcgtcctaaccggcgtctgggtcatagcccacgagtgcggccaccacgcctgcagcgactac

SEQ ID NO: 6756 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtctgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 6757 - DNA, 348 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccagggctgcgtcctaaccggcgtctgggtcatagcccacgagtgcggccaccacgccttcagcgactac

SEQ ID NO: 6758 - DNA, 356 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccagggctgcgtcctaaccggcgtctgggtcatagcccacgagtgcggccaccacgccttcagcgactac

SEQ ID NO: 6759 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaacccgacaacatcaagcgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctactttggcctctctactgggcctgccagggctgcggcctaaccggcgtctgggtcatagcccacgagtgcggcctccacgccttcagcgactac

SEQ ID NO: 6760 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctggcctctctactgggcctgccagggctgcgtcctaaccggcgtctgggtcatagcccacgagtgcggccaccacgccttcagcgactac

SEQ ID NO: 6761 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcagcctctctactgggcctgccaagggggcgtcctaaccggcgtctgggtcatagcccacgagtgcggccaccacgccttcagcgactac

SEQ ID NO: 6762 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaacgggcctctgggtcatagcccacgagtgcggccaccacgccttcagcgactac

SEQ ID NO: 6763 - DNA, 387 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgccatcgtggctggcgatggccaccacctgctcctggcctctctactgggcctgccaagggtgcgtcctaacctgcgtctgggtcatagcccacgagggcggccaccacgccttcagcgactac

SEQ ID NO: 6764 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcggcctaaccggcgtctgggtcatagcccacgagtgcggccaccacgccttcagcgactac

SEQ ID NO: 6765 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgctggcctctctactgggcctgccaagggtgcgtcctaaccggcgtctgggtcatagcccacgagtgcggccaccacgccttcagcgactac

SEQ ID NO: 6766 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttctggcctctctactgggcctgccaagggtgcgtcctaaccggcgtctgggtcatagcccacgagtgcggccaccacgccttcagcgactac

SEQ ID NO: 6767 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcggcctctctactgggcctgccagggctgcgtcctaaccggcgtctgggtcatagcccacgagtgctgccaccacgccttcagcgactac

SEQ ID NO: 6768 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaacgggcctctgggtcatcgcccacgaatgtggccaccacgccttcagcgactac

SEQ ID NO: 6769 - DNA, 421 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgccaggcatcaaataaaacgaaaggctcagtctcggtcgttcggctgcggcgagcggtatcagctcactcaaagcctggcctctctactgggcctgccagggctgcgtcctaaccggcgtctgggtcatagcccacgagtgcggccaccacgccttcagcgactac

SEQ ID NO: 6770 - DNA, 352 bp, Artificial
  Mutation in BnaA.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccgccctggcctctctactgggcctgccagggctgcgtcctaaccggcgtctgggtcatagcccacgagtgcggccaccacgccttcagcgactac

SEQ ID NO: 6771 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctccctctaccacctctccacagcctacttccctctcctcccccaccctctcccttacctcccctctactgggcctgccaaggctgcgtcctaacgggcctctgggtcatcgcccacgaatgcggccaccacgccttcagcgactac

SEQ ID NO: 6772 - DNA, 340 bp, Artificial
  Mutation in BnaA.FAD2.a introduced by TALE nuclease pair BnFAD2_T01
caggatccatgggtgcaggtggaagaatgcaagtgtctccttcctcaaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccatggctgcgtcctaaccggcgtctgggtcagatcccgcgagtgcggccaccacgccatcagcgactac

SEQ ID NO: 6773 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 6774 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctcctctctactgggcctgccaagggtgcgtcctaacgggcctctgggtcatagcccacgagggcggccaccacgccttcagcgactac

SEQ ID NO: 6775 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccagggctgcgtcctaacgggcctctgggtcatcgcccacgaatgcggccaccacgccttcagcgactac

SEQ ID NO: 6776 - DNA, 332 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccaccattcactctcggagacctcaagaaagcaatcccaccgcactgtttcaaacgctcgatccctcgctctttctcctacctcatctgggacatcatcatagcctcctgcttctactacgtcgcctccacttccttccctctcctccctcaccctctctcctgggcctgccagggctgcgtcctaaccggcgtctgggtcatagcccacgagtgcggccaccacgccttcagcgactac

SEQ ID NO: 6777 - DNA, 383 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcagcggctgttgccggtgctgtgccaggcccacggcttctctctactgggcctgccaagggtgcgtcctaacgggcctctgggtcatagcccacgagtgcggccaccacgccttcagcgactac

SEQ ID NO: 6778 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccgacgtctgggtcatagcccacgagtgcggccaccacgccttcagcgactac

SEQ ID NO: 6779 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctccctcatctgggacatcatcatagcctcctgcttctactacgtcgccaccacttacttccctctcctccctcaccctctcgcctacggcctctctactgggcctgccagggctgcgtccgaaccggcgtctgggttatagcccacgagtgcggccaccacgccttcagcgactac

SEQ ID NO: 6780 - DNA, 349 bp, Artificial
  Mutation in BnaA.FAD2.a introduced by TALE nuclease pair BnFAD2_T01
caggatccatgggtgcaggcggaagaatgcaagtgtctcctcactacaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccagggctgcgtcctaaccggcgtctgggtcatagcccacgagtgcggccaccacgcctgcagcgactac

SEQ ID NO: 6781 - DNA, 349 bp, Artificial
  Mutation in BnaA.FAD2.a introduced by TALE nuclease pair BnFAD2_T01
caggatccatgggtgcaggtggaagaatgcaagtgtctactccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttactttcctctcctccctcaccctctctcctcccttggcctctctactgggcctgccagggctgcgtcctaaccggcgtctgggtcatagcccacgagtgcggcctccacgcctgcatcgactac

SEQ ID NO: 6782 - DNA, 387 bp, Artificial
  Mutation in BnaA.FAD2.a introduced by TALE nuclease pair BnFAD2_T01
caggatccatgggtgcaggtggaagaatgcaagtgtctcctacctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccccggagcaggtggtggccatcgccagccacgatggcgcctggcctctctactgggcctgccagggctgcgtcctaaccggcgtctgggtcatagcccacgagtgcggccaccacgccttcagcgactac

SEQ ID NO: 6783 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaacgggcctctgggtcatagcccacgagtgcggccaccacgccttcagctactac

SEQ ID NO: 6784 - DNA, 456 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcagcggctgtcgccggtgctgggccaggcccacggcttgcccccccagcgggtggcggccatcgccagcaatggcggtggcaagcaggcgctggggacggtcccgcctggcctctctactgggcctgccagggctgcgtcctaaccggcgtctgggtcatagcccacgagtgctgccaccacgccttcatcgactac

SEQ ID NO: 6785 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactttttcaaacgctcgatccctcgctctttctcctacctcatctgggacatcatcatagcctcctgcttctactacgtcgccaccacttacttccctctcctccctcaccctctctcctaatggcctctctactgggcctgccagggctgcgtcctaaccggcgtctgggtcatagcccacgagtgcggccaccacgccttcagcgactac

SEQ ID NO: 6786 - DNA, 390 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcggtggcaagcacctgctggggggtcaagccgtgggcggcctctctactgggcctgccaagggtgcgtcctaaccggcgtctgggtcatagcccacgagtgcggccaccacgccttcagcgactac

SEQ ID NO: 6787 - DNA, 346 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaaccggcgtctgggtcatagcccacgagtgcggccaccacgccttcagcgactac

SEQ ID NO: 6788 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacttcgccaccacttacttccctctcctccctcaccctctctcctactctggcctctctactgggcctgccagggctgcgtcctaaccggcgtctgggtcatagcccacgagtgcggccaccacgccttcagcgactac

SEQ ID NO: 6789 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacattggcctctctactgggcctgccagggctgcgtcctaaccggcgtctgggtcatagcccacgagtgcggccaccacgccttcagcgactac

SEQ ID NO: 6790 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgggcctgccagggctgcgtcctaacgggcgtctgggtcatagcccacgagtgcggccaccacgccttcagcgactac

SEQ ID NO: 6791 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaaccggcgtctgggtcatagcccacgagggcggccaccacgccttcagcgactac

SEQ ID NO: 6792 - DNA, 387 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccccggagcaggtggtggccatcgccagccacgatggcgcctggcctctctactgggcctgccagggctgcgtcctaaccggcgtctgggtcatagcccacgagtgcggccaccacgccttcagcgactac

SEQ ID NO: 6793 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaggggtgcgtcctaacgggcctctgggtcatagcccacgagtgcggccaccacgccttcagcgactac

SEQ ID NO: 6794 - DNA, 342 bp, Artificial
  Mutation in BnaA.FAD2.a introduced by TALE nuclease pair BnFAD2_T01
caggatccatgggtgcaggtggaagaatgcaagtctctcctccctccagctcccccgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccagggctgcgtcctaacgggcctctgggtcatagcccacgagtgcggccaccacgccttcagcgactac

SEQ ID NO: 6795 - DNA, 415 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccatgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctccttcgctggagacgatcgcccccacctgctggggggtcaagttgagcggggcacccgtcagtgcatgcatggcctctctactgggcctgccagggctgcgtcctaaccggcgtctgggtcatagcccacgagtgcggccaccacgccttcagcgactac

SEQ ID NO: 6796 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcctctgggtcatagcccacgagtgcggccaccacgccttcagcgactac

SEQ ID NO: 6797 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatccaaccgcactgtttcaaacgctcgatccctcgctctttctcctacctcatctgggacatcatcatagcctcctgcttctactacgtcgccaccacttacttccctctcctccctcaccctctctcctactccgctggcctctctactgggcctgccaagggtgcgtcctaaccggcctctgggtcatagcccacgagtgcggccaccacgccttcagcgactac

SEQ ID NO: 6798 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 6799 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaaccggcgtctgggtcatagcccacgagtgcggccaccacgccttcagcgactac

SEQ ID NO: 6800 - DNA, 349 bp, Artificial
  Mutation in BnaA.FAD2.a introduced by TALE nuclease pair BnFAD2_T01
caggatccatgggtgcaggtggaagaatgcaagtctctcctcactcaaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagtgcggccaccacgccttcagcgactac

SEQ ID NO: 6801 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccagggctgcgtcctaaccggcgtctgggtcatagcccacgagtgcggccaccacgccttcagtgactac

SEQ ID NO: 6802 - DNA, 343 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttctctactgggcctgccagggctgcgtcctaaccggcgtctgggtcatagcccacgaatgcggccaccacgccttcagcgactac

SEQ ID NO: 6803 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaatggtgcgtcctaaccggcgtctgggtcatagcccacgagtgcggccaccacgccttcagcgactac

SEQ ID NO: 6804 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 6805 - DNA, 335 bp, Artificial
  Mutation in BnaA.FAD2.a introduced by TALE nuclease pair BnFAD2_T01
caggatccatgggtgcaggaggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccagggctgcgtcctaaccggcgtctgggtcatagcccacgagtgcggccaccacgccttcagcgactac

SEQ ID NO: 6806 - DNA, 350 bp, Artificial
  Mutation in BnaA.FAD2.a introduced by TALE nuclease pair BnFAD2_T01
caggatccatgtgtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcggctgggtcatagcccacgagtgcggccaccacgccttcagtgactac

SEQ ID NO: 6807 - DNA, 415 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggagacgatggccaccacctgctggggggtcaagttgagcggggcacccgtcagtgcatgcatggcctctctactgggcctgccatggctgcgtcctaaccggcgtctgggtcatagcccacgagtgcggccaccacgccttcagcgactac

SEQ ID NO: 6808 - DNA, 349 bp, Artificial
  Mutation in BnaA.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgctggcctctctactgggcctgccagggctgcgtcctaaccggcgtctgggtcatagcccacgagtgcggccaccacgccttcagcgactac

SEQ ID NO: 6809 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaaggctgcgtcctaactggcctctgtgtcatcgcccacgaatgcggccaccactccttcagcgactac

SEQ ID NO: 6810 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggccttccagggctgcgtcctaaccggcgtctgggtcatagcccacgagtgcggccaccacgccttcagcgactac

SEQ ID NO: 6811 - DNA, 339 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccagggctgcgtcctaacgggcctctgggtcatagcccacgagtgcggccaccacgccttcagcgactac

SEQ ID NO: 6812 - DNA, 349 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggaaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaagggtgcgtcctaaccggcgtctgtgtcatagcccacgagtgcggcctccacgccttcatcgactac

SEQ ID NO: 6813 - DNA, 348 bp, Artificial
  Mutation in BnaA.FAD2.a introduced by TALE nuclease pair BnFAD2_T01
caggatccatgggtgcaagtggaagaatgcaagtgtctcctccctacaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttggcctctctactgggcctgccaagggtgcgtcctaaccggcgtctgggtcatagcccacgagtgcggccaccacgccttcagcgactac

SEQ ID NO: 6814 - DNA, 325 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctctccgacttggctgcgtcctaacgggcctctgggtcatcgcccacgaatgcggccaccacgccttcagcgactac

SEQ ID NO: 6815 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtccgaaccggcgtctgggtcatagcccacgagtgcggccaccacgccttcagcgactac

SEQ ID NO: 6816 - DNA, 387 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccccggagcaggtggtggccatcgccacccacgatggcgcctggcctctctactgggcctgccagggctgcgtcctaaccggcgtctgggtcatagcccacgagtgcggccaccacgccttcagcgactac

SEQ ID NO: 6817 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcgtccaccacgccttcagcgactac

SEQ ID NO: 6818 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactatggcctctctactgggcctgccagggctgcgtcctaaccggcgtctgggtcatagcccacgagtgcggccaccacgccttcagcgactac

SEQ ID NO: 6819 - DNA, 348 bp, Artificial
  Mutation in BnaA.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 6820 - DNA, 436 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggctggcgatggccaccacctgctccggggtcaggccgtgggcctggcatctctgccaaatagttgggagccaatgagggcaggcctctctactgggcctgccaagggtgcgtcctaaccggcgtctgggtcatcgcccacgaatgcggccaccacgccttcagcgactac

SEQ ID NO: 6821 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctccctactgggcctgccagggctgcgtcctaacgggccgctgggtcatcgcccacgaatgcggccaccacgccggcagcgactac

SEQ ID NO: 6822 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctactacaggcctctctactgggcctgccaagggtgcgtcctaaccggcgactgggtcatagcccacgagtgcggccaccacgccatcagcgacgac

SEQ ID NO: 6823 - DNA, 336 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccagggctgcgtcctaaccggcgtctgggtcatagcccacgagtgcggccaccacgccttcagcgactacc

SEQ ID NO: 6824 - DNA, 341 bp, Artificial
  Mutation in BnaA.FAD2.a introduced by TALE nuclease pair BnFAD2_T01
caggatccatgggtgcaggtggaagaatgcaagtgtctcctccgtccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttactgggcctgccagggctgcgtcctaaccggcgtctgggtcatagcccacgagtgcggccaccacgccttcagcgactac

SEQ ID NO: 6825 - DNA, 395 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcaaactcttcctggctagcggtacgcgtattaattgcgtcctggcctctctactgggcctgccaagggggcgtcctaaccggcgtctgggtcatagcccacgagtgcggccaccacgccttcagcgactac

SEQ ID NO: 6826 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccatttacttccctctcctccctcaccctctctcctacttactgggcctgccaaggctgcgtcctaacgggcctctgggtcatcgcccacgaatgcggccaccacgccttcagcgactac

SEQ ID NO: 6827 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggccggccaagggtgcgtcctaaccggcgtctgggtcatagcccacgagtgcggccaccacgccttcagcgactac

SEQ ID NO: 6828 - DNA, 350 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatccaaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 6829 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccaagggtgcgtcctaaccggcgtctgggtcatagcccacgagtgcggccaccacgccttcagcgactac

SEQ ID NO: 6830 - DNA, 341 bp, Artificial
  Mutation in BnaA.FAD2.a introduced by TALE nuclease pair BnFAD2_T01
caggatccatgggtgcaggtgtaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttactgggcctgccagggctgcgtcctaacctgcgtctgggtcatagcccactagtgcggccaccacgccttcagcgactac

SEQ ID NO: 6831 - DNA, 344 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccagggctgcgtcctaaccggcgtctgggtcatagcccacgagtgcggccaccacgccttcagcgactac

SEQ ID NO: 6832 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaacgggcctctgggtcatagcccacgagtgcggccaccacgccttcagcgactac

SEQ ID NO: 6833 - DNA, 331 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgggccggccagggctgcgtcctaaccggcgtctgggtcatagcccacgagtgcggccaccacgccttcagcgactac

SEQ ID NO: 6834 - DNA, 344 bp, Artificial
  Mutation in BnaA.FAD2.a introduced by TALE nuclease pair BnFAD2_T01
cagccatgggtgcaggtggaagaatgcaagtgtctcctccctacaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttcctctcctccctcaccctctctcctacttggcctctctactgggcctgccagggctgcgtcctaaccggcgtctgggtcatagcccacgagtgcggccaccacgcctgcagcgactac

SEQ ID NO: 6835 - DNA, 339 bp, Artificial
  Mutation in BnaA.FAD2.a introduced by TALE nuclease pair BnFAD2_T01
caggatccatgggtgcaggtgcaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccggcctgccagggctgcgtcctaaccggcgtctgggtcatagcccacgagtgcggccaccacgccttcagcgactac

SEQ ID NO: 6836 - DNA, 346 bp, Artificial
  Mutation in BnaA.FAD2.a introduced by TALE nuclease pair BnFAD2_T01
caggatcatgggtgcaggtggaagaatgcaagtgtctcctccctacaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 6837 - DNA, 349 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctacggggcctgccagggctgcgtcctaaccggcgtctgggtcatagcccacgagtgcggccaccacgccttcagcgactac

SEQ ID NO: 6838 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttacctctcctccctcaccctctctcctactctactgggcctgccagggctgcgtcctaaccggcgtctgggtcatagcccacgagtgcggccaccacgccttcagcgactac

SEQ ID NO: 6839 - DNA, 386 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttggccaccacctgctggggggtcaagccgtgggcctggcacagtctctactgggcctgccagggctgcgtcctaaccggcgtctgggtcatagcccacgagggcggccaccacgccttcagcgactac

SEQ ID NO: 6840 - DNA, 348 bp, Artificial
  Mutation in BnaA.FAD2.a introduced by TALE nuclease pair BnFAD2_T01
gaggatccatgggtgcaggtggaagaatgcaagtgtctcctccctccaaaaagtctgaaaccgacaacatcaagcgcgtaccctgcgagacaccgcccttcactggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 6841 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggtcaccacgccttcagcgactac

SEQ ID NO: 6842 - DNA, 334 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcatctcctacatcatcataccctcctgcttctactccgtcgccaccacttacttccctctcctccctcaccctctctctactgggcctgccagggctgcgtcctaaccggcgtctgggtcatagcccacgagtgcggccaccacgccttcagcgactac

SEQ ID NO: 6843 - DNA, 344 bp, Artificial
  Mutation in BnaA.FAD2.a introduced by TALE nuclease pair BnFAD2_T01
caggatccatgggtgcaggtggaagaatgcaagtgtctactccctcaaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgggcctgccagggctgcgtcctaaccggcgtctggttcatagcccacgagtgctgccaccacgccttcagcgactac

SEQ ID NO: 6844 - DNA, 332 bp, Artificial
  Mutation in BnaA.FAD2.a introduced by TALE nuclease pair BnFAD2_T01
caggatccatgggtgcaggtggaagaatgcaagtgtctcatccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaaccggcgtctgggtcatagcccacgagtgcggccaccacgccttcagcgactac

SEQ ID NO: 6845 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcataccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccggggctgcgtcctaaccggcgtctgggtcatagcccacgagtgcggccaccacgccttcagcgactac

SEQ ID NO: 6846 - DNA, 378 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctccagcgcctgcttgccgccagcgtggctggcgatggccaccacctgctccggggtcaagccgtgagggctgggtcatagcccacgagtgcggccaccacgccttcagcgactac

SEQ ID NO: 6847 - DNA, 356 bp, Artificial
  Mutation in BnaA.FAD2.a introduced by TALE nuclease pair BnFAD2_T01
caggatccatgggtgcaggtggaagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccagggctgcgtcctaaccggcgtctgggtcatagcccacgagtgcggccaccacgccttcagcgactac

SEQ ID NO: 6848 - DNA, 349 bp, Artificial
  Mutation in BnaA.FAD2.a introduced by TALE nuclease pair BnFAD2_T01
caggatccatgggtgcaggtggaagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcaccctctctactgggcctgccaagggtgcggcctaaccggcgtctgggtcatagcccacaagtgcgtccaccgcgcctgcagcgactac

SEQ ID NO: 6849 - DNA, 424 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccccttcgccagcgcctgcttcccgccagcgtggctggcgatggccacccccggctccggggtcaagcaggtggtggccactggcctctctactgggcctgccagggctgcgtcctaaccggcgtctgggtcatagcccacgagtgcggccaccacgccttcagcgactac

SEQ ID NO: 6850 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgtttcaaacgctcgatccctcgctctttctcctacctcatctgggacatcatcatagcctcctgcttctactacgtcgccaccacttacttccctctcctccctcaccctctcacctggcctctctacggggcctgccagggctgcgtcctaaccggcgtctgggtcatagcccacgagtgcggccaccacgccttcagcgactac

SEQ ID NO: 6851 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctgcctctctactgggcctgccaaggctgcgtcctaacgggcctctgggtcatcgcccacgaatgcggccaccacgccttcagcgactac

SEQ ID NO: 6852 - DNA, 348 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttggcctctctactgggcctgccaagggggcgtcctaacctgcgtctgggtcatagcccacgagtgcggccaccgcgcctgcagcgactac

SEQ ID NO: 6853 - DNA, 417 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgtcaggacatgatcgcggcgttgccagagcgagatcctccgcgctgtagaagtcaccattgttgtgctggcctctctactgggcctgccagggctgcgtcctaaccggcgtctgggtcatagcccacgagtgcggccaccacgccttcagcgactac

SEQ ID NO: 6854 - DNA, 349 bp, Artificial
  Mutation in BnaA.FAD2.a introduced by TALE nuclease pair BnFAD2_T01
caggatccatgggtgcaggtggaagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 6855 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctaccacctctccacagcctacttccctctcctccccccccctctcccttacctcgcctcgtctggcccctctactgggcctgccaaggctgcgtcctaacgggcctctgggtcatcgcccacgaatgcggccaccacgccttcagcgactac

SEQ ID NO: 6856 - DNA, 348 bp, Artificial
  Mutation in BnaA.FAD2.a introduced by TALE nuclease pair BnFAD2_T01
caggatccatgggtgcaggtggaagaatgcaagtgtctcctccctacaaaaagtctgaaaccgacaacatcaagcgcgtaccctgcgagacaccgcccttcactgtcggagaactcaagaaagcaatcccaccgcactgtttcaaactctcgatccctcgctctttctcctacctcatctgggccatcatcatagcctcctgcttctactacgtcgccaccacttacttctctctcctccctcaccctctctccaacttcgcctctctactggtcctgccaagggtgcgtcctaaccggcgtctgggtcatagcccacaagtgcggccaccgctccttcagcgactac

SEQ ID NO: 6857 - DNA, 430 bp, Artificial
  Mutation in BnaA.FAD2.a introduced by TALE nuclease pair BnFAD2_T01
caggatccatgggtgcaggtggaagaatgcaagtgtctcctacctacaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacgtgtgtacggccagcaacggcggttcgagatggcgctcgatggcgccaacggtggccaccacctgctccggggtcaagccagttggcctctctactggtcctgccagggctgcggcctaaccggcgtctgggtcatagcccacgagtgcggccacgacgccttcagcgacgac

SEQ ID NO: 6858 - DNA, 380 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaccccaagaaagcaatcccacctcactgcttcaaacgctcgatccctcgctctttctcctacctcatctgggacatcatcatagcctcctgcttctactacgtcgccaccacttacttccctctcctccctcaccctctctcctacttcacagtggtccggcgcacgcgctctggaggcctgcctctctactgggcctgccagggctgcgtcctaaccggcgtctgggtcatagcccacgagtgcggccaccacgccttcagcgactac

SEQ ID NO: 6859 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactatcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaaggctgcgtcctaacgggcctctgggtcatcgcccacgaatgcggccaccacgccttcagcgactac

SEQ ID NO: 6860 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactggacctgccaagggtgcgtcctaaccggcgtctgggtcatagcccacgagtgcggccaccacgccttcagcgactac

SEQ ID NO: 6861 - DNA, 341 bp, Artificial
  Mutation in BnaA.FAD2.a introduced by TALE nuclease pair BnFAD2_T01
caggatccatgggtgcaggttgaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacaccatcatagcctcctgcttctactacgtcgccaccacttacttccctctcctccctcaccctctctcctacttcgcctgggcctgccagggctgcgtcctaaccggcgtctgggtcatagcccacgagtgcggccaccacgcctgcagcgactac

SEQ ID NO: 6862 - DNA, 344 bp, Artificial
  Mutation in BnaA.FAD2.a introduced by TALE nuclease pair BnFAD2_T01
caggatccatgggtgcaggtgtaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccggcctctctactgggcctgccaagggtgcgtcctaaccggcgtctgggtcatagcccacgagtgcggccaccacgccttcagcgactac

SEQ ID NO: 6863 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccagggctgcggcctaaccggcgtctgggtcatagcccacgagtgcggccaccacgccttcagcgactac

SEQ ID NO: 6864 - DNA, 348 bp, Artificial
  Mutation in BnaA.FAD2.a introduced by TALE nuclease pair BnFAD2_T01
caggatccatgggtgcaggtggaagaatgcaagtctctcctccctacaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcgtccaccacgccttcagcaactac

SEQ ID NO: 6865 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttccctctctactgggcctgccagggctgcgtcctaaccggcgtctgggtcatagcccacgagtgcggccaccacgccttcagcgactac

SEQ ID NO: 6866 - DNA, 344 bp, Artificial
  Mutation in BnaA.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccagggctgcgtcctaaccggcgtctgggtcatagcccacgagtgcggccaccacgccttcagcgactac

SEQ ID NO: 6867 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccctggcctctctactgggcctgccagggctgcgtcctaaccggcgtctgggtcatagcccacgagtgcggccaccacgccttagcgactac

SEQ ID NO: 6868 - DNA, 350 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctggcctctctactgggcctgccagggctgcgtcctaaccggcgtctgggtcatagcccacgagtgcggccaccacgccttcagcgactac

SEQ ID NO: 6869 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggctgcgtcctaaccggcgtctgggtcatagcccacgagtgcggccaccacgccttcagcgactac

SEQ ID NO: 6870 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctactgcttctactacgtcgccaccacttacttccctctcctccctcaccctctctcctacttcgtggcctctctactgggcctgccagggctgcgtcctaaccggcgtctgggtcatagcccacgagtgcggccaccacgccttcagcgactac

SEQ ID NO: 6871 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgggcctctctactgggcctgccaaggctgcgtcctaacgggcctctgggtcatagcccacgagtgcggccaccacgccttcagcgactac

SEQ ID NO: 6872 - DNA, 338 bp, Artificial
  Mutation in BnaA.FAD2.a introduced by TALE nuclease pair BnFAD2_T01
caggatccatgtgtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcatagcccacgagtgcggccaccacgccagcagcaactac

SEQ ID NO: 6873 - DNA, 344 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccagggctgcgtcctaaccggcgtctgggtcatagcccacgagtgcggccaccacgccttcagcgactac

SEQ ID NO: 6874 - DNA, 344 bp, Artificial
  Mutation in BnaA.FAD2.a introduced by TALE nuclease pair BnFAD2_T01
caggatccatgggtgcaggtggaagaatgcaagtctctactccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccagggctgcgtcctaaccggcgtctgggtcatagcccacgagtgcgtccaccacgccttcagcgactac

SEQ ID NO: 6875 - DNA, 277 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcggaccctgcgagacaccgcccttcactgtcggagaactcaagaaagcaatcccaccgcactgtttcaaacgctcgatccctcgctctttctcctacctcatctgggacatcatcatagcctcctggttctactacgtcgccaccacttatgtccctctcctccttctcccactctcctacatcgcgccttttgtgactac

SEQ ID NO: 6876 - DNA, 438 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctctatccctcgctctttctcctacctcatctgggacatcatcatagcctcctgcttctactacgtcgccaccacttacttccctctcctccctcaccctctctcctacttcgccagctgggccttgtagttgcccttgaagtggccggacccgaacaggaacttgaactcggtcacgctggaggggtacaccttccacctggcctctctactgggcctgccaagggtgcgtcctaaccggcgtctgggtcatagcccacgagtgcggccaccacgccttcagcgactac

SEQ ID NO: 6877 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccagggctgcgtcctaacgggcctctgggtcatagcccacgagtgcggccaccacgccttcagcgactac

SEQ ID NO: 6878 - DNA, 349 bp, Artificial
  Mutation in BnaA.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtaatagcccacgagtgcggccaccacgccttcagcgactac

SEQ ID NO: 6879 - DNA, 417 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgtcaggacgcgatcgcagcgttgccagggcgggatcctccgcgctgtagaattcaccattgttgggctggcctctctactgggcctgccagggctgcgtcctaaccggcgtctgggtcatagcccacgagtgcggccaccacgccttcagcgactac

SEQ ID NO: 6880 - DNA, 329 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaaccggcgtctgggtcatagcccacgagtgcggccaccacgccttcagcgactac

SEQ ID NO: 6881 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaacgggcctctgggtcatagcccacgagtgcggccaccacgccttcagcgactac

SEQ ID NO: 6882 - DNA, 349 bp, Artificial
  Mutation in BnaA.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccgcgccttcagcgactac

SEQ ID NO: 6883 - DNA, 347 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccctctctactgggcctgccagggctgcgtcctaaccggcgtctgggtcatagcccacgagtgcggccaccacgccttcagcgactac

SEQ ID NO: 6884 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttcgcctctctactgggcctgccagggctgcgtcctaaccggcgtctgggtcatagcccacgagtgcggccaccacgccttcagcgactac

SEQ ID NO: 6885 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaactctcgatccctcgctctttctcctacctcatctgggacatcatcatagcctcctgcttctactacgtcgccaccacttacttccctctcctccctcaccctctctcctaccgccctggcctctctactgggcctgccagggctgcgtcctaaccggcgtctgggtcatagcccacgagtgcggccaccacgccttcagcgactac

SEQ ID NO: 6886 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgccctctctactgggcctgccagggctgcgtcctaaccggcgtctgggtcatagcccacgagtgcggccaccacgccttcagcgactac

SEQ ID NO: 6887 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccctcactgtgggagaactcaagaaagcaatcccaccgcactgtttcaaacgctcgatccctagctctttctcctacctcatctgggacatcatcatagcctcctgcttctactacgtcgccaccacttacttccctcccctccctcaccctctctcctccttcgcctggtcgtgccagggctgcgtcctaaccggcgtctgggtcatatcctacgagtgcgtccaccgcgtctgcagcgactac

SEQ ID NO: 6888 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatcccacgctccttctcctcttcgacatcatcatctcctcctcggctcctccctctaccacctctccacagcctacttccctctcctccctcaccctctctctggcctctctactgggcctgccagggctgcgtcctaaccggcgtctgggtcatggcgcacgagtgcgtccaccacgcctgcagcgactac

SEQ ID NO: 6889 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttgagcgactac

SEQ ID NO: 6890 - DNA, 352 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccagggctgcgtcctaaccggcgtctgggtcatagcccacgagtgcggccaccacgccttcagcgactac

SEQ ID NO: 6891 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttggcctctctactgggcctgccagggctgcgtcctaaccggcgtctgggtcatagcccacgagtgcggccaccacgccttcagcgactac

SEQ ID NO: 6892 - DNA, 340 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctactttactgggcctgccagggctgcgtcctaaccggcgtctgggtcatagcccacgagtgcggccaccacgccttcagcgactac

SEQ ID NO: 6893 - DNA, 346 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 6894 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcgagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactggtcctgccagggctgcgtcctaaccggcgtctgggtcatagcccacgagtgcggccaccacgccttcagcgactac

SEQ ID NO: 6895 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctctctactgggcctgccaaggctgcgtcctaacgggcctctgggtcatcgcccacgaatgcggccaccacgccttcagcgactac

SEQ ID NO: 6896 - DNA, 354 bp, Artificial
  Mutation in BnaA.FAD2.a introduced by TALE nuclease pair BnFAD2_T01
caggtccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcgctggcctctctactgggcctgccagggctgcgtcctaaccggcgtctgggtcatagcccacgagtgcggccaccacgccttcagcgactac

SEQ ID NO: 6897 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgggcctctctactgtgcctgccagggctgcgtcctaaccggcgtctgggtcatagcccacgagtgcggccaccacgccttcagcgactac

SEQ ID NO: 6898 - DNA, 417 bp, Artificial
  Mutation in BnaA.FAD2.a introduced by TALE nuclease pair BnFAD2_T01
caggatccatgggtgcaggtggaagaatgcaagtgtctcccccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctacttctactacgtcgccaccacttacttccctctcctccctcaccctctctccgacttcgtcaggacatgatcgcagcgttgccagagcgagatgctccgcgctgtagaagtcaccattgttgtgctggcctctctactgggcctgccagggctgcgtcctaaccggcgtctgggtcatagcccacgagtgcggccaccacgccttcagcgactac

SEQ ID NO: 6899 - DNA, 430 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttatgtacggccagcaacgtcggttcgagatggcgctcgatgacgccaacgatggccaccacctgctccggggtcaagccagttggtctctctactgggcctgccagggctgcgtcctaaccggcgtcggggtcatagcccacgagtgcggccaccacgcctgcagcgactac

SEQ ID NO: 6900 - DNA, 335 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccagggctgcgtcctaaccggcgtctgggtcatagcccacgagtgcggccaccgcgccttcagcgactac

SEQ ID NO: 6901 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctctctactgggcctgccaggtctgcgtcctaacgggcctctgggtcatagcccacgagtgcggccaccacgccttcagcgactac

SEQ ID NO: 6902 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagaactcaagaaagcaatcccaccgcactgtttcaaacgctcgatccctcgctctttctcctacctcatctaggacatcatcatagcctcctgcttctactacgtcgccaccacttacttccctctcctccctcaccctctctcctaatggcctctctactgggcctgccagggctgcgtcctaaccggcgtctgggtcatagcccacgagtgcggccaccacgccttcagcgactac

SEQ ID NO: 6903 - DNA, 349 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacccaggcctctctactgggcctgccaagggtgcgtcctaaccggcgtctgggtcatagcccacgagtgcggccaccacgccttgagcgactac

SEQ ID NO: 6904 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatatcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 6905 - DNA, 357 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgcccgcctggcctctctactgggcctgccagggctgcgtcctaaccggcgtctgggtcatagcccacgagtgcggccaccacgccttcagcgactac

SEQ ID NO: 6906 - DNA, 350 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttctggcctctctactgggcctgccagggctgcgtcctaagcggcgtgtgggtcatagcccacatgtgcgtccaccgctccttctgcgactac

SEQ ID NO: 6907 - DNA, 352 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaaacgcgtaccctgcgagacaccgcccttcactgtcggagaactcaagaaagcaatcccaccgcactgtttcaaacgctcgatccctcgctctttctcctacctcatctggcacatcatcatagcctcctgcttctactacgccgccaccacttacttccctctcctccctcaccctctctcctacccccctggcctctctactgggcctgccagggctgcgtcctaaccggcgtctgggtcatagcccacgagtgcggccaccacgccttcagcgactac

SEQ ID NO: 6908 - DNA, 325 bp, Artificial
  Mutation in BnaA.FAD2.a introduced by TALE nuclease pair BnFAD2_T01
caggatccatgggtgcaggtggaagaatgcaagtatctcctccctccaaaaagtctgaaaccgacaccctcaaccgcgtaccctgcgagacacctcccttcactgtcggagaactcaagaaagcaatcccacctcactgtttcaaacgctcgatccctcgctctttctcctacctcatctgggacatcatcatcgcctcctgcttctactacctcgccaccgcttacttccctctcctccctcaccctctccccgccttggctgcgtcctaaccggcgtctgggtcatagcccacgagtgcggccaccacgccttcagcgactac

SEQ ID NO: 6909 - DNA, 348 bp, Artificial
  Mutation in BnaA.FAD2.a introduced by TALE nuclease pair BnFAD2_T01
caggatccatgggtgcaggtggaagaatgcaagtgtctcctaactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgcctgcagcgactac

SEQ ID NO: 6910 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 6911 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaacagacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgcctctctactgggcctgccaagggtgcgtcctaaccggcgtctgggtcatagcccacgagtgcggccaccacgccttcagcgactac

SEQ ID NO: 6912 - DNA, 277 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcctgcagcgactac

SEQ ID NO: 6913 - DNA, 343 bp, Artificial
  Mutation in BnaA.FAD2.a introduced by TALE nuclease pair BnFAD2_T01
caggatccatgggtgcaggtggaagaatgcaagtgtctcctccctcaaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcaccagcctctctactgggcctgccagggctgcgtcctaaccggcgtctgggtcatagcccacgagtgcggccaccacgccttcagcgactac

SEQ ID NO: 6914 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcccccgcctggcctctctactgggcctgccagggctgcgtcctaaccggggtctgggtcatagcccacgagtgcggccaccacgccttcagcgactac

SEQ ID NO: 6915 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagccccctgcttatactacgtcgccaccacttacttccctctcctccctcaccctctcccccaccggcccctctactgggcctgccaaggctgcgtcctaacgggcctctgtgtcatcgcccacgagtgcggccaccacgccttcagcgactac

SEQ ID NO: 6916 - DNA, 352 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgctggcctctctactgggcctgccagggctgcgtcctaaccggcgtctgggtcatagcccacgagtgcggccaccacgccttcagcgactac

SEQ ID NO: 6917 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcctctactacgtcgccaccacttacttccctctcctccctcaccctctctcctacgtcgccgcctggcctctctactgggcctgtcaaggctgcgtcctaacgggcctctgggtcatagcccacgagtgcggccaccacgccttcagcgactac

SEQ ID NO: 6918 - DNA, 334 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccacgagtgcggccaccacgccttcagcgactac

SEQ ID NO: 6919 - DNA, 300 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccaagggtgcgtcctaaccagcgtctgggtcatagcccacgagtgcggccaccacgccttcagcgactac

SEQ ID NO: 6920 - DNA, 387 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccccggagcaggtggtggccatcgccagccacgatggcgcctggcctctctactgggcctgccagggctgcgtcctaaccggcgtctgggtcatagcccacgagtgcggccaccacgccttcagcgactac

SEQ ID NO: 6921 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaacagacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttctggcctctctactgggcctgccagggctgcgtcctaaccggcgtctgggtcatagcccacgagtgcggccaccacgccttcagcgactac

SEQ ID NO: 6922 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctccctggcccctctactgggcctgccaaggctgcgtcctaacgggcctctgggtcatcgcccacgaatgcggccaccacgccttcagcgactac

SEQ ID NO: 6923 - DNA, 347 bp, Artificial
  Mutation in BnaA.FAD2.a introduced by TALE nuclease pair BnFAD2_T01
caggatccatgggtgcaggtggaagaatgcaagtctctcctacctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacaggcctctctactgggcctgccagggctgcgtcctaaccggcctctgggtcatagcccacgagtgcggccaccacgcctgcagcgactac

SEQ ID NO: 6924 - DNA, 355 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 6925 - DNA, 348 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggtcatcacgccttcagcgactac

SEQ ID NO: 6926 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgccctcttctctctactgggcctgccagggctgcgtcctaaccggcgtctgggtcatagcccacgagtgcggccaccgcgccttcagcgactac

SEQ ID NO: 6927 - DNA, 409 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgctggagacggtgcaggcgctgttgccggtgctgtgccaggcccacggcttgacccccctggcctctctactgggcctgccagggctgcgtcctaaccggcgtctgggtcatagcccacgagtgcggccaccacgccttcagcgactac

SEQ ID NO: 6928 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttggcctctctactgggcctgccagggctgcgtcctaaccggcgtctgggtcatagcccacgagtgcggccaccacgccttcgcgactac

SEQ ID NO: 6929 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgtcagggctgcgtcctaacgggcctctgggtcatagcccacgagtgcggccaccacgccttcagcgactac

SEQ ID NO: 6930 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 6931 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccggcctctctactgggcctgccaaggctgcgtcctaaccggcgtctgggtcatagcccacgagtgcggccaccacgccttcagcgactac

SEQ ID NO: 6932 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaaccggcgtctgggtcatagcccacgagtgcggccaccacgccttcagcgactac

SEQ ID NO: 6933 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaaggctgcgtcctaacgggcctctgggtcatagcccacgagtgcggccaccacgccttcagcgactac

SEQ ID NO: 6934 - DNA, 341 bp, Artificial
  Mutation in BnaA.FAD2.a introduced by TALE nuclease pair BnFAD2_T01
caggatccatgggtgcaggtggaagaatgcaagtctctactccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctactgggcctgccagggctgcggcctaaccggcgtctgggtcatagcccacgagtgcggccaccacgccttcagcgactac

SEQ ID NO: 6935 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgcctgcagcgactac

SEQ ID NO: 6936 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaatcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtctgggtcatagcccacgagtgcggccaccacgccttcagcgactac

SEQ ID NO: 6937 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacgtcctctctactgggcctgccagggctgcgtcctaaccggcctctgggtcatagcccacgagtgcggccaccacgccttcagcgactac

SEQ ID NO: 6938 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccactacttacttccctctcctccctcaccctctctcctatggcctctctactgggcctgccaagggtgcgtcctaaccggcgtctgggtcatagcccacgagtgcggccaccacgccttcagcgactac

SEQ ID NO: 6939 - DNA, 344 bp, Artificial
  Mutation in BnaA.FAD2.a introduced by TALE nuclease pair BnFAD2_T01
caggatccatgggtgcaggtggaagaatgcaagtctctactccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctcccctccctcaccctctcccctagcctctctactgggccttccagggctgcggcctgaccggcgtctggggcatagcccacgagtgcggccaccacgccttcagcgactac

SEQ ID NO: 6940 - DNA, 356 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagacctcaagaaagcaatcccacctcactgcttcaaacgctccatccctcgctccttctcctacctcgtctgggacatcatcatagcctcctgcttctactacgtcgccaccacttacttccctctcctccctcaccctctcccctccttcgccgcctggcctctctactgggcctgccagggctgcgtcctaaccggcgtctgggtcatagcccacgagtgcgtccaccacgccttcagcgactac

SEQ ID NO: 6941 - DNA, 352 bp, Artificial
  Mutation in BnaA.FAD2.a introduced by TALE nuclease pair BnFAD2_T01
caggatccatgggtgcaggtggaagaatgcaagtgtctcctcccaccaaaaagtctgaaaccgacaacatcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccacttcgcctggcctctctactgggcctgccagggctgcgtcctaaccggcgtctgggtcatagcccacgagtgcgtccaccgcgccttcagcgactac

SEQ ID NO: 6942 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttagcctctctactgggcctgccagggctgcgtcctaaccggcgtctgggtcatagcccacgagtgcggccaccacgccttcagcgactac

SEQ ID NO: 6943 - DNA, 347 bp, Artificial
  Mutation in BnaA.FAD2.a introduced by TALE nuclease pair BnFAD2_T01
caggatccatgggtgcagtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 6944 - DNA, 334 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccagggctgcgtcctaaccggcgtctgggtcatcgcccacgaatgcggccaccacgccttcagcgactac

SEQ ID NO: 6945 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtaggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctacgcctggcctctctactgggcctgccaagggtgcgtcctaaccggcgtctgggtcatagcccacgagtgcggccaccacgccttcagcgactac

SEQ ID NO: 6946 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatcgcccacgaatgcggccaccacgccttcagcgactac

SEQ ID NO: 6947 - DNA, 430 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttatgtacggccagcaacgtcggttcgagatggcgctcgatgacgccaacgatggccaccacctgctccggggtcaagccagttggcctctctactgggcctgccagggctgcgtcctaaccggcgtctgggtcatagcccacgagtgcggccaccacgcctgcagcgactac

SEQ ID NO: 6948 - DNA, 332 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcagcctctctactgggcctgccagggctgcgtcctaaccggcgtctgggtcatagcccacgagtgcggccaccacgccttcagcgactac

SEQ ID NO: 6949 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctccctcaccctctcacctggcctctctactgggcctgccaagggtgcgtcctaaccggcgtctgggtcatagcccacgagtgcggccaccacgccttcagcgactac

SEQ ID NO: 6950 - DNA, 351 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggggcctctctactgggcctgccaagggtgcgtcctaaccggcgtcggggtcatagcccacgagtgcggccaccacgccttcagcgactac

SEQ ID NO: 6951 - DNA, 349 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgctcctactccgccgccaccacttacttccctctcctccctcaccctctctcctcccttggcctctctactgggcctgccagggctgcgtcctaaccggcgtctgggtcatagcccacgagtgcggccaccacgccttcagcgactac

SEQ ID NO: 6952 - DNA, 356 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgccgcctggcctctctactgggcctaccagggctgcgtcctaaccggcgtctgggtcatagcccacgagtgcggccaccacgccttcagcgactac

SEQ ID NO: 6953 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccagggctgcgtcctaaccggcgtctgggtcatagcccacgagtgcggccaccacgccttcagcgactac

SEQ ID NO: 6954 - DNA, 327 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcacctcatctgggacatcatcatagcctcctgcttctactacgtcgccaccacttacttccctctcctccctcaccctctctgggcctgccagggctgcgtcctaaccggcgtctgggtcatagcccacgagtgcggccaccacgccttcagcgactac

SEQ ID NO: 6955 - DNA, 419 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacaaagactgggcctttcgttttatctgttgtttgtcggtgaacgctcgcctgagtaggacaaatccgctcccttggcttttttactgggcctgccaagggtgcgtcctaaccggcgtctgggtcatagcccacgagtgcggccaccacgccttcagcgactac

SEQ ID NO: 6956 - DNA, 338 bp, Artificial
  Mutation in BnaA.FAD2.a introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcatagcccacgagtgcggccaccacgccttcagcgactac

SEQ ID NO: 6957 - DNA, 341 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccagggctgcgtcctaacgggcctctgggtcatagcccacgagtgcggccaccacgccttcagcgactac

SEQ ID NO: 6958 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgcctgcagcgactac

SEQ ID NO: 6959 - DNA, 334 bp, Artificial
  Mutation in BnaA.FAD2.a introduced by TALE nuclease pair BnFAD2_T01
caggatccatgggtgcagatggaagaatgcaagtgtctcctccctccaaaaagtctgaaaccgacaacatcaagcgcgtaccctgccagacaccacccttcactgtcggagaactcaagaaagcaatcccaccgcactgtttcaaaagctcgatccctcgctctttctcctacctcatctgggacatcatcatagcctcctgcttctactacgtcgccaccacttacttccctctcctccctctccctctctctactgggcctgccagggcggcggcgtaacctgcggctgggtcatagcccacgagttcggccaccactccttgagcgactac

SEQ ID NO: 6960 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatcgcccacgaatgcggccaccacgccttcagcgactac

SEQ ID NO: 6961 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctctactgggcctgccaaggctgcgtcctaacgggcctctgggtcatagcccacgagtgcggccaccacgccttcagcgactac

SEQ ID NO: 6962 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccttgcgagacaccccccttcactgtcggacaactcaagaaagcaatcccaccgcactgtttcaaccgctcgatccctcgctctttctcctacctcatctgggacatcatcatagcctcctgcttctactacgtcgccaccacttacttccctctcctccctcaccctctctcctccttcgccctctctactgggcctgccagggctgcgtcctaaccggcgtctgggtcatagcccacgagtgcggccaccacgccttcagcgactac

SEQ ID NO: 6963 - DNA, 351 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtctgggtcatagcccacgagtgcggccaccacgccttcagcgactac

SEQ ID NO: 6964 - DNA, 348 bp, Artificial
  Mutation in BnaA.FAD2.a introduced by TALE nuclease pair BnFAD2_T01
caggatccatgggtgcaggtggaagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacgtggcctctctactgggcctgccagggctgcgtcctaaccggcgtctgggtcatagcccacgagtgcgtccaccacgcctgcagcgactac

SEQ ID NO: 6965 - DNA, 335 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgcggccaccacgccttcagcgactac

SEQ ID NO: 6966 - DNA, 335 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccagggctgcgtcctaacgggcctctgggtcatagcccacgagtgcggccaccacgccttcagcgactac

SEQ ID NO: 6967 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaacgggcctctgggtcatcgcccacgaatgcggccaccacgccttcagcgactac

SEQ ID NO: 6968 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttcctctctactgggcctgccagggctgcgtcctaaccggcgtctgggtcatagcccacgagtgcggccaccacgccttcagcgactac

SEQ ID NO: 6969 - DNA, 349 bp, Artificial
  Mutation in BnaA.FAD2.a introduced by TALE nuclease pair BnFAD2_T01
caggatccatgggtgcaggttgaagaatgcaagtgtctaccccctccaagaagtctgaaaccgacaccatcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttcggcctctctactgggcctgccagggctgcggcctaaccggcgtctgggtcatagcccacgagtgcggccaccacgccttcagcgactac

SEQ ID NO: 6970 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgcccccacttacttccctctcctccctcaccctctctcctagcctctctactggacctgccaagggtgcgtcctaaccggcgtctgggtcatagcccacgagtgcggccaccacgccttcagcgactac

SEQ ID NO: 6971 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccggcctctctactgggcctgccagggctgcgtcctaacgggcctctgggtcatagcccacgagtgcggccaccacgccttcagcgactac

SEQ ID NO: 6972 - DNA, 349 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactccgtcgccaccacttacttccctctcctccctcaccctctctcctcccccgccctctctactgggcctgccagggctgcgtcctaaccggcgtctgggtcatagcccacgagtgcggccaccacgccttcagcgactac

SEQ ID NO: 6973 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 6974 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgtttcaaacgctcgatccctcgctctttctcctacctcatctgggacatcatcatagcctcctgcttctactacgtcgccaccacttacttccctctcctccctcaccctctctctctctactgggcctgccaagggtgcgtcctaaccggcgtctgggtcatagcccacgagtgcggccaccacgccttcagcgactac

SEQ ID NO: 6975 - DNA, 380 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctctcctacttcacagtggtccggcgcccgcgctctggaggcctgcctctctactgggcctgccaagggtgcgtcctaaccggcgtctgggtcatagcccacgagtgcggccaccacgccttcagcgactac

SEQ ID NO: 6976 - DNA, 455 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgctggcccctccccagcgcctgcttgccgccatcgtggctggcgatggccaccacctgctccggggtcaagccgtgggcctggcacagcaccggcaacagccgcttggcctctctactgggcctgccagggctgcgtcctaaccggcgtctgggtcatagcccacgagtgcggccaccacgccttcagcgactac

SEQ ID NO: 6977 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccaagggtgcgtcctaaccggcgtctgggtcatagcccacgagtgcggccaccacgccttcagcgactac

SEQ ID NO: 6978 - DNA, 344 bp, Artificial
  Mutation in BnaA.FAD2.a introduced by TALE nuclease pair BnFAD2_T01
caggatccatgggtgcaggtggaagaatgcaagtctctcctccctccagctcccccggaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccagggctgcgtcctaaccggcgtctgggtcatagcccacgagtgcggccaccacgccttcagcgactac

SEQ ID NO: 6979 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcatctgggacatcatcatagcctcctgcttctactacgtcgccaccacttacttccctctcctccctcaccctctcgcctggcctctctactgggcctgccagggctgcgtcctaaccggcgtctgggtcatagcccacgagtgcggccaccacgccttcagcgactac

SEQ ID NO: 6980 - DNA, 436 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttcgccctggctggcgatggccaccacctgctccggggtcaagccgtgggcctggcatctctgccaaatagttgggagccaatgagggcaggcctctctactgggcctgccaagggtgcgtcctaaccggcgtctgggtcatagcccacgagtgcggccaccacgccttcagcgactac

SEQ ID NO: 6981 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaacgggcctctgggtcatcgcccacgaatgcggccaccacgccttcagcgactac

SEQ ID NO: 6982 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgattcctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 6983 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttccctgccctctactgggcctgccaaggctgcgtcctaacgggcctctgggtcatagcccacgagtgcggccaccacgccttcagcgactac

SEQ ID NO: 6984 - DNA, 400 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcctcaccctctctcctacttcggtccagcgcctgcttgccaccattattgctggcgatggccaccacctgctgggcctctctactgggcctgccaagggtgcgtcctaaccggcgtctgggtcatagcccacgagtgcggccaccacgccttcagcgactac

SEQ ID NO: 6985 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccagggctgcgtcctaaccggcgtctgggtcatagcccacgagtgcgtccaccacgccttcagcgactac

SEQ ID NO: 6986 - DNA, 357 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcgcccgcctggcctctctactgggcctgccggggctgcgtcctaaccggcgtctgggtcatagcccacgagtgcggccaccacgccttcagcgactac

SEQ ID NO: 6987 - DNA, 331 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccatctcctccctcaccctctctccgggcctgccagggctgcgtcctaacgggcctctgggtcatcgcccacgaatgcggccaccacgccttcagcgactac

SEQ ID NO: 6988 - DNA, 332 bp, Artificial
  Mutation in BnaA.FAD2.a introduced by TALE nuclease pair BnFAD2_T01
caggatccatgggtgcaggtggaagaatgcaagtgtcccctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccagggctgcgtcctaaccggcgtctgggtcatagcccacgagtgcggccaccacgccttcagcgactac

SEQ ID NO: 6989 - DNA, 352 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgccggcctctctactgggcctgccagggctgcgtcctaaccggcgtctgggtcatagcccacgagtgcggccaccacgccttcagcgactac

SEQ ID NO: 6990 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgtggcctctctactgggcctgccaagggtgcgtcctaaccggcgtctgggtcatagcccacgagtgcggccaccacgccttcagcgactac

SEQ ID NO: 6991 - DNA, 331 bp, Artificial
  Mutation in BnaA.FAD2.a introduced by TALE nuclease pair BnFAD2_T01
caggatccatgggtgcaggtggaagaatgcaagtgtatcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcagggcctgccagggctgcgtcctaacgggcctctgggtcatagcccacgagtgcggccaccacgccttcagcgactac

SEQ ID NO: 6992 - DNA, 429 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgggcgtcctgcccgccaccctccgggccgttgcttcacaccatcgtggctggcgatggccaccacctgctccggggtcatggcctctctactgggcctgccagggctgcgtcctaaccggcgtctgggtcatagcccacgagtgcggccaccacgccttcagcgactac

SEQ ID NO: 6993 - DNA, 332 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaacgggcctctgggtcatcgcccacgaatgcggccaccacgccttcagcgactac

SEQ ID NO: 6994 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcatctgggacatcatcatagcctcctgcttctactacgtcgccaccacttacttccctctcctccctcaccctctcgcctaggcctctctactgggcctgccaagggtgcgtcctaacaggcgtctgggtcatagcccacgagtgcggcccccacgccttcagcgactac

SEQ ID NO: 6995 - DNA, 347 bp, Artificial
  Mutation in BnaA.FAD2.a introduced by TALE nuclease pair BnFAD2_T01
caggatccatgggtgcaggtggaagaatgcaagtatctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 6996 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccacctcactgcttcaaacgctccatcccacgctccttctcctacctcatctgcgacatcatcatcgcctcctgcttctactccgccgccacctcttacttccctctccgccctcaccctctctcctacgtctggcctctctactgggcctgccagggctgcgtcctaaccggcgtctgggtcatagcccacgagtgcggccaccacgccttcagcgactac

SEQ ID NO: 6997 - DNA, 340 bp, Artificial
  Mutation in BnaA.FAD2.a introduced by TALE nuclease pair BnFAD2_T01
gcaggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggcctgccagggctgcgtcctaaccggcgtctgggtcatagcccacgagtgcggccaccacgcctgcagcgactac

SEQ ID NO: 6998 - DNA, 347 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatccaaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 6999 - DNA, 348 bp, Artificial
  Mutation in BnaA.FAD2.a introduced by TALE nuclease pair BnFAD2_T01
caggatccatgggtgcaggtagaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 7000 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggcctgccagggctgcgtcctaaccggcgtctgggtcagagcgcacgagggcggccaccacgccttctgcgactac

SEQ ID NO: 7001 - DNA, 343 bp, Artificial
  Mutation in BnaA.FAD2.a introduced by TALE nuclease pair BnFAD2_T01
caggatccatgggtgcagctggaagaatgcaagtgtcccctccctccaaaaagtctgaaaccgacaacatcaagcgcgtaccctgcgagacaccgcccttcactgtcggagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 7002 - DNA, 340 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactcggcctgccaagagtgcgtcctaacctgcgtctgggtcatagcccaccagtgcggccaccacgccttcagcgactac

SEQ ID NO: 7003 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtctggcctctctactgggcctgccagggctgcgtcctaaccggcgtctgggtcatagcccacgagtgcggccaccacgcctgcagcgactac

SEQ ID NO: 7004 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagttcgtccaccacgccttcagcgactac

SEQ ID NO: 7005 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaacctacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtctggcctctctactgggcctgccaagggtgcgtcctaaccggcgtctgggtcatagcccacgagtgcggccaccacgccttcagcgactac

SEQ ID NO: 7006 - DNA, 349 bp, Artificial
  Mutation in BnaA.FAD2.a introduced by TALE nuclease pair BnFAD2_T01
caggatccattggtgcaggtggaagaatgcaagtgtctcctccctccaaaaagtctgaaaccgacaacatcaagcgcgtaccctgcgagacaccgcccttcactgtcggataactcaagaaagcaatcccaccgcactgtttcaaacgctcgatccctcgctctttctcctacctcatctgggacatcgtcatagcctcctgcttctactacgtcgccaccacttacttccctctcctccctcaccctctctcctactttggcctctctactgggcctgccaagggtgcgtcctaaccggcgtctgggtcatagcccccgagtgcggccaccccgccttcagcgactac

SEQ ID NO: 7007 - DNA, 398 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttgccttggcaacgctgcgatcatgtcctgatacttgacagcgacggtccctggcctctctactgggcctgccaagggtgcgtcctaaccggcgtctgggtcatagcccacgagtgcggccaccacgccttcagcgactac

SEQ ID NO: 7008 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccaagggtgcgtcctaaccggcgtctgggtcatagcccacgagtgcggccacaacgccttcagcgactac

SEQ ID NO: 7009 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaaacaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgccttcagcgactac

SEQ ID NO: 7010 - DNA, 344 bp, Artificial
  Mutation in BnaA.FAD2.a introduced by TALE nuclease pair BnFAD2_T01
caggatccattggtgcaggtgaaagaatgcaagtgtctcctccctacaaaaagtctgaaaccgacaacatcaagcgcgtaccctgcgagacaccgcccttcactgtcggagaactcaagaaagcaatcccaccgcactgcttcaaacgctcaatccctcgctcattctcctacctcatctgggtcatcatcatagcctcctgcttctactacgtcgccaccacttacttccctctcctccctcaccccctcccccggcctctctactgggcctgccagggctgcgtcctaaccggcttctggggcatagcccacgagtgcggccgccacgccttcagcgactac

SEQ ID NO: 7011 - DNA, 348 bp, Artificial
  Mutation in BnaA.FAD2.a introduced by TALE nuclease pair BnFAD2_T01
caggatccatgggtgcaggtggaagaatgcaagtgtctccaccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccatcagcgactac

SEQ ID NO: 7012 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagtgtgcgtcctaaccggcgtctgggtcatagcccacgagtgcggccaccacgccttcagcgactac

SEQ ID NO: 7013 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctctccctctcccccactcctctctactgggcctgccaagggtgcgtcctaaccggcgtctgggtcatagcccacgagtgcggccaccacgccttcagcgactac

SEQ ID NO: 7014 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 7015 - DNA, 346 bp, Artificial
  Mutation in BnaA.FAD2.a introduced by TALE nuclease pair BnFAD2_T01
caggatccatgggagcaggtggaagaatgcaagtgtctccaccctccaaaaagtctgaaaccgacaacatcaagcgcgtaccctgcgagacaccgcccttcactgtctgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaaccggcgtctgggtcatagcccacgagtgcggccaccacgccttcagcgactac

SEQ ID NO: 7016 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacctctctactgggccggccaggggggcgtcctagcgggcctctgggtgagagcccacgagtgcggccaccacgccttcagcgacgac

SEQ ID NO: 7017 - DNA, 356 bp, Artificial
  Mutation in BnaA.FAD2.a introduced by TALE nuclease pair BnFAD2_T01
caggatccatgggtgcaggtggaagaatgcaagtgtcccctctcttaaagaagtctgaaaccgacaccatcaagcgcgtaccctgcgagccaccgcccttcactgtcggagaactcaagaaagcaatcccaccgcaatgtttcaaacgctcgatacctcgctctctctcctacctcatctgggacatcatcatagcctcctgcttctaatacgtcgccaccacttacttccctctcctccctctccctctcccctactgcgccgcctagcctctctactgggcctgccagggctgcgtcttgaccggcgtctggggcataggccacgagtgcgtccaccacgccttcagcgactac

SEQ ID NO: 7018 - DNA, 341 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcatcgactac

SEQ ID NO: 7019 - DNA, 348 bp, Artificial
  Mutation in BnaA.FAD2.a introduced by TALE nuclease pair BnFAD2_T01
caggatccatgggtgcaggtagaagaatgcaagtgacacctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggccatcatcatagcctcctgcttctactacgtcgccaccacttacttccctctcctccctcaccctctcccccacctcgcctctctactgggcctgccagggctgcgtcctaaccggcgtctgggtcatagcccacgagtgcggccaccacgccttcagcgactac

SEQ ID NO: 7020 - DNA, 415 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggagacgatggccaccacctgctggggggtcaagttgagcggggcacccgtcagtgcatgcatggcctctctactgggcctgccagggctgcgtcctaaccggcgtctgggtcatagcccacgagtgcggccaccacgccttcagcgactac

SEQ ID NO: 7021 - DNA, 343 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttctctactgggcctgccagggctgcgtcctaaccggcgtctgggtcatagcccacgagtgcggccaccacgccttcagcgactac

SEQ ID NO: 7022 - DNA, 350 bp, Artificial
  Mutation in BnaA.FAD2.a introduced by TALE nuclease pair BnFAD2_T01
caggatccatgggtgcaggtggaagaatgcaagtgtctcctccctccaataagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttttggcctctctactgggcctgccagggctgcgtcctaaccggcgtcttggtcatagcccacgagtgcggccaccacgccttcagcgactac

SEQ ID NO: 7023 - DNA, 354 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctccccctggcctctctactgggcctgccagggctgcgtcctaaccggcgtctgggtcatagcccacgagtgcggccaccacgccttcagcgactac

SEQ ID NO: 7024 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccccctcccttacctcgcctctactgggcctgccaaggctgcgtcctaacgggcctctgggtcatcgcccacgaatgcggccaccacgccttcagcgactac

SEQ ID NO: 7025 - DNA, 334 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccagggctgcgtcctaaccggcgtctgggtcatagcccacgagtgcggccaccacgccttcagcgactac

SEQ ID NO: 7026 - DNA, 329 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaaccggcgtctgggtcatagcccacgagtgcggccaccacgccttcagcgactac

SEQ ID NO: 7027 - DNA, 351 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcctctctactgggcctgccaagggtgcgtcctgatgggcctctgggtcatagcccacgagtgcggccaccacgccttcagcgactac

SEQ ID NO: 7028 - DNA, 348 bp, Artificial
  Mutation in BnaA.FAD2.a introduced by TALE nuclease pair BnFAD2_T01
catgatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttggcctctctactgggcctgccagggctgcgtcctaacgggcctctgggtcatcgcccacgaatgcggccaccacgccttcagcgactac

SEQ ID NO: 7029 - DNA, 341 bp, Artificial
  Mutation in BnaA.FAD2.a introduced by TALE nuclease pair BnFAD2_T01
caggatccatgggtgcaggtggaagaatgcaagtgtctcccccctacaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttactgagccggccaggactgcgtcctaaccggcgtctaggtcatcgcccacaagtgcggtcaccgcgccttcatcgactac

SEQ ID NO: 7030 - DNA, 416 bp, Artificial
  Mutation in BnaA.FAD2.a introduced by TALE nuclease pair BnFAD2_T01
caggatccatgggtgcaggtggaagaatgcaagtgtctactcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttcgtcaggacatgatcgcagcgttgccagagcgagattctccgcgctgtagaagtcaccattgttgtgctggcctctctactgggccgccagggctgcgtcctaaccggcgtctgggtcatagcccacgagtgcggccaccacgccttcagcgactac

SEQ ID NO: 7031 - DNA, 349 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctaatctgggacatcatcatagcctcctgcttctactacgtcgccaccacttacttccctctcctccctcaccctctatcctacttctgcctctctactgggcctgccagggctgcgtccgaacgggcctctgggtcatcgcccacgaatgcggccaccacgccttcagcgactac

SEQ ID NO: 7032 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 7033 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 7034 - DNA, 386 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggccaccacctgctggggggtcaggccgtgggccgggcacagtctctactgggcctgccagggctgcgtcctaacgggcctctgggtcatagcccacgagtgcggccaccacgccttcagcgactac

SEQ ID NO: 7035 - DNA, 347 bp, Artificial
  Mutation in BnaA.FAD2.a introduced by TALE nuclease pair BnFAD2_T01
caggatccatgggtgcaggtggaagaatgcaagtgtctcctccgtccaaaaactctgaaaccgacaacctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccccttacttccctctcctccctcaccctctctcctacttgcctctctactgggcctgccaagggtgcgtcctaaccggcgtctgggtcatagcccacgagtgcggccaccacgccctcagcgactac

SEQ ID NO: 7036 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccggcctctctactgggcctgccaagggtgcgtcctaaccggcgtctgggtcatagcccacgagtgcggccaccacgccttcagcgactac

SEQ ID NO: 7037 - DNA, 344 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctagcctctctactgggcctgccagggctgcgtcctaaccggcgtctgggtcatagcccacgagtgcggccaccacgccttcagcgactac

SEQ ID NO: 7038 - DNA, 387 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccccgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacaacggctgataggatcccccaatccctttttcactgcatctggcccctctactgggcctgccaaggctgcgtcctaacgggcctctgggtcatcgcccacgaatgcggccaccacgccttcagcgactac

SEQ ID NO: 7039 - DNA, 349 bp, Artificial
  Mutation in BnaA.FAD2.a introduced by TALE nuclease pair BnFAD2_T01
caggatccatggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccactgacttccctctcctccctcaccctctctcctacttcaggcctctctactgggcctgccaagggtgcggcctaaccggcgtcggggtcacagcccacaagtgcggccaccacgccttcagcgactac

SEQ ID NO: 7040 - DNA, 350 bp, Artificial
  Mutation in BnaA.FAD2.a introduced by TALE nuclease pair BnFAD2_T01
caggatccatgggtgcaggtggaagaatgcaagtgtctcctccctccaggaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 7041 - DNA, 348 bp, Artificial
  Mutation in BnaA.FAD2.a introduced by TALE nuclease pair BnFAD2_T01
caggatcatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 7042 - DNA, 334 bp, Artificial
  Mutation in BnaA.FAD2.a introduced by TALE nuclease pair BnFAD2_T01
caggatccatgggtgcaggtggaagaatgcaagtgtctcccccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccactctctactgggccttccagagctgcggcctgaccggcgtctgggtcatagcccgcaagtgcggccaccgcgccttcagcgactgc

SEQ ID NO: 7043 - DNA, 339 bp, Artificial
  Mutation in BnaA.FAD2.a introduced by TALE nuclease pair BnFAD2_T01
caggatcaatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgggtcatagcccacgagtgcggccaccacgccttcagcgactac

SEQ ID NO: 7044 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgacgac

SEQ ID NO: 7045 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtctgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcctctctactgggcctgccaagggtgcgtcctaaccggcgtctgggtcatagcccacgagtgcggccaccacgccttcagcgactac

SEQ ID NO: 7046 - DNA, 334 bp, Artificial
  Mutation in BnaA.FAD2.a introduced by TALE nuclease pair BnFAD2_T01
caggatccatgggtgcaggtggaagaatgcaagtctatcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccagggctgcgtcctaaccggcgtctgggtcatagcccacgagtgcggccaccacgccttcagcgactac

SEQ ID NO: 7047 - DNA, 352 bp, Artificial
  Mutation in BnaA.FAD2.a introduced by TALE nuclease pair BnFAD2_T01
caggatccatgggtgcaggtggaagaatgcaagtctcccctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccagggctgcgtcctaaccggcgtctgggtcatagcccacgagtgcggccaccacgccttcagcgactac

SEQ ID NO: 7048 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccaccggcctctctactgggcctgccaagggtgcgtcctaaccggcgtctgggtcaaaacccacgagtgcggccaccacgccttcagcgactac

SEQ ID NO: 7049 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccggggctgcgtcctaaccggcgtctgggtcatagcccacgagtgcggccaccacgccttcagcgactac

SEQ ID NO: 7050 - DNA, 356 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcactctttctcctacctcatctgggacatcatcatagcctcctgcttctactacgtcgccaccacttacttccctctcctccctcaccctctcgcctacttcgccgccgggcctctctactgggcctgccagggctgcgtcctaaccggcgtctgggtcatagcccacgagggcggccaccacgccttcagcgactac

SEQ ID NO: 7051 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcccctctctactgggcctgccagggctgcgtcctaacgggcctctgggtcatcgcccacgaatgcggccaccacgccttcagcgactac

SEQ ID NO: 7052 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaacgggcctctgggtcatcgcccacgaatgcggccaccacgccttcagcgactac

SEQ ID NO: 7053 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttactgggcctgccagggctgcgtcctaaccggcgtcttggtcatagcccacgagtgcggccaccacgccttcagcgacgac

SEQ ID NO: 7054 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggaactgccaagggtgcgtcctaaccggcctctgggtcatagcccacgagtgcggccaccacgccttcagcgactac

SEQ ID NO: 7055 - DNA, 424 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactgtgccaggcccacggcttgaccccggagcaggtggtggccatcgccagccacgatggcggcaagcaggcgctggactggcctctctactgggcctgccagggctgcgtcctaaccggcgtctgggtcatagcccacgagtgcggccaccacgccttcagcgactac

SEQ ID NO: 7056 - DNA, 353 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgcttcaaacgctccatcccacgctccttctcctcttcgacatcatcatctcctcctcggctcctccctctaccacctctccacagcctacttccctctcctccctcaccctctctcctcctccgctggcctctctactgggcctgccagggctgcgtcctaacgggcctctgggtcatagcccacgagtgcggccaccacgccttcagcgactac

SEQ ID NO: 7057 - DNA, 334 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggataactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccagggctgcgtcctaaccggcgtctgggtcatagcccacgagtgcggccaccacgcctgcagcgactac

SEQ ID NO: 7058 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctatcctctctactgcgcctgccaaggctgcgtcctaacgggcgtctgggtcattgcccacgagtgcggcctccacgccttcagcgactac

SEQ ID NO: 7059 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagccgcctgcttctactacgtcgccaccacttacttccctctcctccctcaccctctctcctccttcgccgcctggcctctctactgggcctgccaagggtgcgtcctaaccggcgtctgggtcatagcccacgagtgcggccaccacgccttcagcgactac

SEQ ID NO: 7060 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgagtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcatagcccacgattgcggccaccacgccttcagcgactac

SEQ ID NO: 7061 - DNA, 321 bp, Artificial
  Mutation in BnaA.FAD2.a introduced by TALE nuclease pair BnFAD2_T01
caggatccatgggtgcaggcggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaaccggcgtctgggtcatagcccacgagtgcggccaccacgccttcagcgactac

SEQ ID NO: 7062 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccctcaaacgcgtcccctgcgagacaccacccttcactctcggagacctcaagaaagcaatcccacctcactgcttcaaacgctcgatccctcgctctttctcctacctcatctgggacatcatcatagccccctgcttctactacgtcgccaccacttacttccctctcctccctcaccctctctcctactttgcctctctactgggcctgccagggctgcgtcctaaccggcgtctgggtcatagcccacgagtgcggccaccacgccttcagcgactac

SEQ ID NO: 7063 - DNA, 349 bp, Artificial
  Mutation in BnaA.FAD2.a introduced by TALE nuclease pair BnFAD2_T01
cagggtccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcggcctctctactgggcctgccagggctgcgtcctaaccggcgtctgggtcatagcccacgagttcggccaccacgccttcagcgactac

SEQ ID NO: 7064 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgctggcctctctactgggcctgccaaggctgcgtcctaacgggcctctgggtcatcgcccacgaatgcggccaccacgccttcagcgactac

SEQ ID NO: 7065 - DNA, 405 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcaatgcactgacggttgccccgctcaacttgaccccccagcaggtggtggccagcggcctctctactgggcctgccaagggtgcgtcctaaccggcgtctgggtcatagcccacgagtgcggccaccacgccttcagcgactac

SEQ ID NO: 7066 - DNA, 347 bp, Artificial
  Mutation in BnaA.FAD2.a introduced by TALE nuclease pair BnFAD2_T01
caggatccatgggtgcaggtggaagaatgcaagtgtctcctccctccaggaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 7067 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggccttccagggctgcgtcctaaccggcgtctgggtcatagcccacgagtgcggccaccacgccttcagcgactac

SEQ ID NO: 7068 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttggcctctctactgggcctgccaaggctgcgtcataacgggcctctgggtcatcgcccacgaatgcggccaccacgccttcagcgactac

SEQ ID NO: 7069 - DNA, 351 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcctggcctctctactgggcctgccagggctgcgtcctaaccggcgtctgggtcatagcccacgagtgcggccaccacgccttcagcgactac

SEQ ID NO: 7070 - DNA, 349 bp, Artificial
  Mutation in BnaA.FAD2.a introduced by TALE nuclease pair BnFAD2_T01
caggatccatgggtgcaggtggaagaatgcaagtgtctcctacatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccaagggtgcgtcctaaccggcgtctgggtcatagcccacgagtgcggccaccacgccttcagcgactac

SEQ ID NO: 7071 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctaggcctctctactgggcctgccagggctgcgtccgaacaggcgtctgggtcatagctcacgagtgcggccaccacgccttgagcgactac

SEQ ID NO: 7072 - DNA, 346 bp, Artificial
  Mutation in BnaA.FAD2.a introduced by TALE nuclease pair BnFAD2_T01
caggatccatgggtgcaggtagaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaaccggcgtctgggtcatagcccacgagtgcggccaccacgccttcagcgactac

SEQ ID NO: 7073 - DNA, 393 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctaacggtgcaggcgctgttgccggtgctgtgccaggcccacggcttgacccctggcctctctactgggcctgccagggctgcgtcctaaccggcgtctgggtcatagcccacgagtgcggccaccacgccttcagcgactac

SEQ ID NO: 7074 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgcttcaaacgctccatcccacgctccttctcctacctcatctgggacatcatcatagcctcctgcttctactacgtcgccaccacttacttccctctcctccctcagcctctctactgggcctgccaagggtgcgtcctaaccggcgtctgggtcatagcccacgagtgcggccaccacgccttcagcgactac

SEQ ID NO: 7075 - DNA, 348 bp, Artificial
  Mutation in BnaA.FAD2.a introduced by TALE nuclease pair BnFAD2_T01
aggatccatgggtgcaggtggaagaatgcaagtctctcctccctccagctcccccggaaccaacacccacaaacgcgtcccctgcgagacaccaccattcactctcggagacctcaagaaagcaatcccacctcactgcttcaaaagctccatcccacgctccttctcctacctcatctgggacatcatcatagcctcctgcttctactacgtcgccaccacttacttccctctcctccctcaccctctctcctactttggcctctctactgggcctgccagggctgcgtcctaacgggcgtctgggtcatagcccacgagtgcggccaccacgccttcagcgactac

SEQ ID NO: 7076 - DNA, 343 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttctctactgggcctgccaagggtgcgtcctaaccggcgtctgggtcatagcccacgagtgcggccaccacgccttcagcgactac

SEQ ID NO: 7077 - DNA, 346 bp, Artificial
  Mutation in BnaA.FAD2.a introduced by TALE nuclease pair BnFAD2_T01
caggatccatgggtgcaggtggaagaatgcaagtgtctcatccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggccggccatggctgcgtcctaaccggcgtctgggtcatagcccacgagtgcggccaccacgccttcagcgactac

SEQ ID NO: 7078 - DNA, 334 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccagggctgcgtcctaaccggcctctgggtcatagcccacgagtgcggccaccacgccttcagcgactac

SEQ ID NO: 7079 - DNA, 455 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaacttaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgctggaccgtctccagcgcctgcttgccgccatcgtggctggcgatggcccccacctgctccggggtcaagccgtgggcctggcacagcaccggcaacagccgcttggcctctctactgggcctgccagggctgcgtcctaaccggcgtctgggtcatagcccacgagtgcggccaccacgccttcagcgactac

SEQ ID NO: 7080 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctggcctctctactgggcctgccagggctgcgtcctaaccggcgtctgggtcatagcccacgagtgcggccaccacgccttcagcgactac

SEQ ID NO: 7081 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaaggctgcgtcctaacgggcctctgggtcatcgcccacgaatgcggccaccacgccttcagcgactac

SEQ ID NO: 7082 - DNA, 339 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgccggcctgccagggctgcgtcctaaccggcgtctgggtcatagcccacgagtgcggccaccacgccttcagcgactac

SEQ ID NO: 7083 - DNA, 429 bp, Artificial
  Mutation in BnaA.FAD2.a introduced by TALE nuclease pair BnFAD2_T01
caggatccatgggtgcaggcggaagaatgcaagtctctcctccctccagctcccccggaaccaacaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgggcgtcctgcccgccaccccccgggccgttgcttcacaccatcgtggctggcgatggccaccacctgctccggggtcatggcctctctactgggcctgccagggctgcgtcctaaccggcgtctgggtcatagcccacgagtgcggccaccacgccttcagcgactac

SEQ ID NO: 7084 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagtgcggccaccacgccttcagcgactac

SEQ ID NO: 7085 - DNA, 424 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgtgccaggcccacggcttgaccccggagcaggtgggggccatcgccagccacgatggcggcaagcaggcgctggactggcctctctactgggcctgccaagggtgcgtcctaaccggcgtctgggtcatagcccacgagtgcggccaccacgccttcagcgactac

SEQ ID NO: 7086 - DNA, 350 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctggcctctctactgggcctgccaagggtgcgtcctaaccggcgtctgggtcatagcccacgagtgcggccaccacgccttcagcgactac

SEQ ID NO: 7087 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggtctctctactgggcctgccaagggtgcgtcctaaccggcgtctgggtcatagcccacgagtgcggccaccacgccttcagcgactac

SEQ ID NO: 7088 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgctgctactacgtcgccaccacttacttccctctcctccctcaccctctctccagcttggcctctctactgggcctgccaagggtgcgtcctaaccggcgtctgggtcatagcccacgagtgcggccaccacgccttcagcgactac

SEQ ID NO: 7089 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggggcctctctactgggcctgccagggctgcgtcctaaccggcgtctgggtcatagcccacgagtgcggccaccacgccttcagcgactac

SEQ ID NO: 7090 - DNA, 277 bp, Artificial
  Mutation in BnaA.FAD2.a introduced by TALE nuclease pair BnFAD2_T01
caggatccatgggtgcaggtcgaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacgccttcagcgactac

SEQ ID NO: 7091 - DNA, 343 bp, Artificial
  Mutation in BnaA.FAD2.a introduced by TALE nuclease pair BnFAD2_T01
caggatccatgggtgcaggtgaaagaatgcaagtgtctcatccctccaaaaagtctgaaaccgacaacatcaagcgcgtaccctgcgagacaccgcccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggccggccaagggtgcgtcctaaccggcgtctgggtcatagcccacgagtgcggccaccacgccatcagcgactac

SEQ ID NO: 7092 - DNA, 352 bp, Artificial
  Mutation in BnaA.FAD2.a introduced by TALE nuclease pair BnFAD2_T01
caggatccatgggtgcaggtggaagaatgcaagtgtctcacccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctggcctctctactgggcctgccaagggtgcgtcctaaccggcgtctgggtcatagcccacgagtgcggccaccacgccttcagcgactac

SEQ ID NO: 7093 - DNA, 355 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatccagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcccctggcctctctactgggcctgccaagggtgcgtcctaaccggcgtctgggtcatagcccacgagtgcggccaccacgccatcagcgactac

SEQ ID NO: 7094 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctccttcctcaccctctctcctaggcctctctactgggcctgccagggctgcgtcctaaccggcgtctgggtcatagcccacgagtgcggccaccacgccttcagcgactac

SEQ ID NO: 7095 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctcttctcctacctcatctgggacatcatcatagcctcctgcttctactacgtcgccaccacttacttccctctcctccctcaccctctctcctacttttactgggcctgccagggctgcgtcctaaccggcgtctgggtcatagcccacgagtgcggccaccacgccttcagcgactac

SEQ ID NO: 7096 - DNA, 334 bp, Artificial
  Mutation in BnaA.FAD2.a introduced by TALE nuclease pair BnFAD2_T01
caggatccatgggtgcaggtggaagaatgcaagtgtatcctccactcaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgcctgggctgcgtcctaaccggcgtctgggtcatagcccgcgtgtggggcctccacgccttgagccactac

SEQ ID NO: 7097 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgcctttagcgactac

SEQ ID NO: 7098 - DNA, 355 bp, Artificial
  Mutation in BnaA.FAD2.a introduced by TALE nuclease pair BnFAD2_T01
caggatccatgggtgcaggtggaagaatacaagtgtctcctacctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcctggcctctctactgggcctgccagggctgcgtcctaaccggcgtctgggtcatagcccacgagtgcggccaccacgccttcagcgactac

SEQ ID NO: 7099 - DNA, 354 bp, Artificial
  Mutation in BnaA.FAD2.a introduced by TALE nuclease pair BnFAD2_T01
caggatccatgggtgctggaagaatgcaagtctctcctccctccaaaaagtctgaaaccgacaacatcaagcgcgtaccctgcgagacaccgcccttcactgtcggagaactcaagaaagcaatcccaccgcactgcttcaaacgctccatccctcgctctttctcctacctcatctgggacatcatcatagcctcctgcttctactacgtcgccaccacttacttccctctcctccctcaccctctctcctacttcgcgcgcctggcctctctactgggcctgccaagggtgcgtcctaaccggcgtctgggtcatagcccacgagtgcggccaccacgccttcagcgactac

SEQ ID NO: 7100 - DNA, 429 bp, Artificial
  Mutation in BnaA.FAD2.a introduced by TALE nuclease pair BnFAD2_T01
caggatccatgggtgcaggtggaagaatgcaagtgtctcctccctccaaaaagtctggaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccgggcgtcctccccgcccccctccgggccgttgcttcacaccatcgtggctggcgatggccaccacctgctccggggtcatggcctctctactgggcctgccagggctgcgtcctaaccggcgtctgggtcatagcccacgagtgcggccaccacgccttcagcgactac

SEQ ID NO: 7101 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggcctgccaagggtgcgtcctaaccggcgtctgggtcatagcccacgagtgcggccaccacgccttcagcgctac

SEQ ID NO: 7102 - DNA, 328 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctcggctcctcccccaccctctctcctacttcgcccgcctggcctctctactgggcctgccagggctgcgtcctaacgggcctctgggtcatagcccacgagtgcggccaccacgccttcagcgactac

SEQ ID NO: 7103 - DNA, 311 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatcccacgctccttctcctcttcgacatcatcatctcctcctcggctcctccctcaccctctctcctacttgcctctctactgggcctgccagggctgcgtcctaaccggcgtctgggtcatagcccacgagtgcggccaccacgccttcagcgactac

SEQ ID NO: 7104 - DNA, 417 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttccactacgtcgccaccacttacttccctctcctccctcaccctctctcctacttcgtcaggacatgatcgcagcgttgccagagcgagattctccgcgctgtagaagtcaccattgttgtgctggcctctctactgggcctgccagggctgcgtcctaaccggcgtctgggtcatagcccacgagtgcggccaccacgccttcagcgactac

SEQ ID NO: 7105 - DNA, 342 bp, Artificial
  Mutation in BnaA.FAD2.a introduced by TALE nuclease pair BnFAD2_T01
caggatcatgggtgcaggtggcagaatgcaagtgtcccctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctggcctctctactgggcctgccagggctgcgtcctaaccggcgtctgggtcatcgcccacgaatgcggccaccacgccttcagcgactac

SEQ ID NO: 7106 - DNA, 355 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcgctggcctctctactgggcctgccaaggctgcgtcctaaccggcgtctgggtcatagcccacgagtgcggccaccacgccttcagcgactac

SEQ ID NO: 7107 - DNA, 347 bp, Artificial
  Mutation in BnaA.FAD2.a introduced by TALE nuclease pair BnFAD2_T01
caggaccatgggtgcaggtggaagaatgcaagtgtctcctccctccaaaaagtctgaaaccgacaacatcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 7108 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaaccccaccgcactgtttcaaacgctcgatccctcgctctttctcctacctcatctgggacatcatcatagcctcctgcttctactacgtcgccaccacttacttccctctcctccctcaccctctctccgatggcctctctactgggcctgccagggctgcgtcctaacgggcctctgggttatcgcccacgaatgcggccaccacgccttcagcgactac

SEQ ID NO: 7109 - DNA, 329 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaaccggcgtctgggtcatagcccacgagtgtggccaccacgccttcagcgactac

SEQ ID NO: 7110 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgactggcctctctactgcgcctgccagggctgcgtcctaaccggcgtctgggtcatagcccacgagtgcggccaccacgccttcagcgactac

SEQ ID NO: 7111 - DNA, 346 bp, Artificial
  Mutation in BnaA.FAD2.a introduced by TALE nuclease pair BnFAD2_T01
caggatccatgggtgcaggtgcaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaaccggcgtctgggtcatagcccacgagtgcggccaccacgccttcagcgactac

SEQ ID NO: 7112 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacaccaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccagggctgcgtcctaaccggcgtctgggtcagagcccacgaatgctgccaccacgccatcagcgactac

SEQ ID NO: 7113 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgtgcctgccagggctgcgtcctaaccggcgtctgggtcatagcccacgagtgcggccaccacgccttcagcgactac

SEQ ID NO: 7114 - DNA, 345 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccagggctgcgtcctaaccggcgtctgggtcatagcccacgagtgcggccaccacgccttcagcgactac

SEQ ID NO: 7115 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcatcctctctcccacctggcctctctactgggcctgccagggctgcgtcctaaccggcgtctgggtcatagcccacgagtgcggccaccacgccttcagcgactac

SEQ ID NO: 7116 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgttggcctctctactgggcctgccaaggctgcgtcctaacgggcgtctgggtcatagcccacgagtgcggccaccacgccttcagcgactac

SEQ ID NO: 7117 - DNA, 350 bp, Artificial
  Mutation in BnaA.FAD2.a introduced by TALE nuclease pair BnFAD2_T01
caggatccatgggtgcaggaggaagaatgcaagtgtctcctacccccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggctggcctctctactgggcctgccaagggtgcgtcctaaccggcgtctgggtcagagcccacgagtgcggccaccacgccttcagcgactac

SEQ ID NO: 7118 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcagagcccacgagtgcggccaccacgccttcagcgactac

SEQ ID NO: 7119 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaatggcctctctactgggcctgccagggcttcgtcctaaccggcgtctgggtcatagcccacgagtgcggccaccacgccttcagcgactac

SEQ ID NO: 7120 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgaaacctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttccttccctctcctccctcaccctctctcctatggcctctctactgggcctgccagggctgcgtcctaaccggcgtctgggtcatagcccacgagtgcggccaccacgccttcagcgactac

SEQ ID NO: 7121 - DNA, 455 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggaccgtctccagcgcctgcttgccgccatcgtggctggcgatggccaccacctgctccggggtcaagccgtgggcctggcacagcaccggcaacagccgcctggcctctctactgggcctgccagggctgcgtcctaaccggcgtctgggtcatagcccacgagtgcggccaccacgccttcagcgactac

SEQ ID NO: 7122 - DNA, 338 bp, Artificial
  Mutation in BnaA.FAD2.a introduced by TALE nuclease pair BnFAD2_T01
caggatccatgggtgcaggtggaagaatgcaagtgtctcctccctcccaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcctgccaagggtgcgtcctaaccggcgtctgggtcatagcccacgagtgcggccaccacgccttcagcgactac

SEQ ID NO: 7123 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaaggctgcgtcctaacgggcctctgggtcatagcccccgagtgcggccaccacgccttcagcgactac

SEQ ID NO: 7124 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggcctgccagggctgcgtcctaaccggcgtctgggtcatagcccacgagtgcggccaccacgccttcagcgactac

SEQ ID NO: 7125 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcttccctcaccctctctcctatcctctctactgggcctgccagggctgcgtcctaaccggcgtctgggtcatagcccacgagtgcggccaccacgccttcagcgactac

SEQ ID NO: 7126 - DNA, 346 bp, Artificial
  Mutation in BnaA.FAD2.a introduced by TALE nuclease pair BnFAD2_T01
caggatccatgggtgcaggcggaagaatgcaagtgtcccctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccatcagcgactac

SEQ ID NO: 7127 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 7128 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtccgaaccggcgtctgggtcatagcccacaattgcggcgaccacgccatcagcgactac

SEQ ID NO: 7129 - DNA, 346 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgagtgcggccaccacgccttcagcgactac

SEQ ID NO: 7130 - DNA, 350 bp, Artificial
  Mutation in BnaA.FAD2.a introduced by TALE nuclease pair BnFAD2_T01
caggatccatgggtgcaggtggaagaatgcaagtctctcctccctccaactcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtctggcctctctactgggcctgccagggctgcgtcctagccggcgtctgggtcatagcccacgagtgcggccaccaggccttcagcgactac

SEQ ID NO: 7131 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaatagtctgaaaccgacaccctcaagcgcgtcccctgcgagacaccacccttcactgtcggagaactcaagaaagcaatcccaccgcactgtttcaaacgctctatccctcgctctttctcctacctcatctgggacatcatcatagcctcctcccctcctccctctaccacctctccccagcctactcccctctcctccctcgccccctcaccgggcctgccaaggctgcgtcctaaccggcgtctgggtcatagcccacgagtgcggccaccacgccttcagcgactac

SEQ ID NO: 7132 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaacctacaacctcaaactcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccactctctactgggcctgccagggctgcgtcctaaccggcgtctgggtcatagcccacgagtgcggccaccacgccttcagcgactac

SEQ ID NO: 7133 - DNA, 329 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaacgggcctctgggtcagcgcccacgaatgcggccaccacgccttcagcgactac

SEQ ID NO: 7134 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtcttaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 7135 - DNA, 342 bp, Artificial
  Mutation in BnaA.FAD2.a introduced by TALE nuclease pair BnFAD2_T01
caggatccatgggtgcaggtgaaagaatgcaagtgtaacctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccagggctgcgtcctaaccggcgtctgggtcatagcccacgagtgtggccaccacgccttcagcgactac

SEQ ID NO: 7136 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccagggctgcgtcctaaccggcgtctgggtcatagcccacgagtgcggccaccacgccttcagcgactac

SEQ ID NO: 7137 - DNA, 343 bp, Artificial
  Mutation in BnaA.FAD2.a introduced by TALE nuclease pair BnFAD2_T01
caggatccatgggtgcaggtggaagaatgcaagtgtctcatccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttctctactgggcctgccagggctgcgtcctaaccggcgtctgggtcatagcccacgagtgcggccaccacgccttcagcgactac

SEQ ID NO: 7138 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggctggcctctctactggggctgccagggctgcgtgctaaccggggtctgggtgagggcccacgggtggggcggcgggggcgtcggcgactac

SEQ ID NO: 7139 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcccctggcctctctactgggcctgccagggctgcgtccgaaccggcgtctgggtcatagcccacgagtgcggccaccacgccttcagcgactac

SEQ ID NO: 7140 - DNA, 348 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 7141 - DNA, 346 bp, Artificial
  Mutation in BnaA.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaacgggcctctgggtcatcgcccacgaatgcggccaccacgccttcagcgactac

SEQ ID NO: 7142 - DNA, 343 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcgagcgcgtaccctgcgagacaccgcccttcactgtcggagagctcaagaaagcaatcccaccgcactgtttcaaacgctcgatccctcgctctttctcctacctcatctgggacatcatcatagcctcctgcttctactacgtcgccaccacttacttccctctcctccctcaccctctcccctgcctctctactgggcctgccaagggtgcgtcctaaccggcgtctgggtcatagcccacgagtgcggccaccacgccttcagcgactac

SEQ ID NO: 7143 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctctctactgggcctgccagggctgcgtcctaaccggcgtcggggtcatatcccacgagtgcggccaccacgccttcagcgactac

SEQ ID NO: 7144 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcatgcttctactacgtcgccaccacttacttccctctcctccctcaccctctctcctactgggcctgccagggctgcgtcctaaccggcgtctgggtcatagcccacgagtgcggccaccacgccttcagcgactac

SEQ ID NO: 7145 - DNA, 352 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctctttctcctacctcatctgggacatcatcatagcctcctgcttctactacgtcgccaccacttacttccctctcctccctcaccctctcccctcctccgctggcctctctactgggcctgccagggctgcgtcctaaccggcgtctgggtcatagcccacgagtgcggccaccacgccttcagcgactac

SEQ ID NO: 7146 - DNA, 415 bp, Artificial
  Mutation in BnaA.FAD2.a introduced by TALE nuclease pair BnFAD2_T01
caggatccatgggtgcaggtggaagaatgcaagtgtgacctccctccaaaaagtctgaaaccgacaacatcaaccgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatcgctggagacgatggccaccacctgctggggggtcaagttgagcggggcacccgtcagtgcaggcatggcctctctactgggcctgccagggctgcgtcctaaccggcgtctgggtcagagcccacgagtgcggccaccacgcctttagcgactac

SEQ ID NO: 7147 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcggcctctctactgggcctgccagggctgcgtcctaaccggcgtctgggtcatagcccacgagtgcggccaccacgccttcagcgactac

SEQ ID NO: 7148 - DNA, 342 bp, Artificial
  Mutation in BnaA.FAD2.a introduced by TALE nuclease pair BnFAD2_T01
caggatccatgggtgcaggtggaagaatgcaagtgtatcctccttccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctctctactgggcctgccagggctgcgtcctaaccggcgtcggggtcatagcccacgagtgcggccaccacgccttcatcgactac

SEQ ID NO: 7149 - DNA, 348 bp, Artificial
  Mutation in BnaA.FAD2.a introduced by TALE nuclease pair BnFAD2_T01
caggatccatgggtgcaggtggaagaatgcaagtgtctcccccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtcggggtcatagcccacgagtgcggccaccacgccttcagcgactac

SEQ ID NO: 7150 - DNA, 346 bp, Artificial
  Mutation in BnaA.FAD2.a introduced by TALE nuclease pair BnFAD2_T01
caggatccatgggtgcagggggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcctctctactgggcctgccaagggtgcgtcctaaccggcgtctgggtcatagcccacgagtgcggccaccacgccttcagcgactac

SEQ ID NO: 7151 - DNA, 409 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctccttcgcaggggacggtgcaggcgctgttgccggtgctgtgccaggcccacggcttgacccccctggcctctctactgggcctgccagggctgcgtcctaaccggcgtctgggtcatagcccacgagtgcggccaccacgccttcagcgactac

SEQ ID NO: 7152 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgactggcctctctactgggcctgccaagggtgcgtcctaaccggcgtctgggtcatagcccacgagtgcggccaccacgccttcagcgactac

SEQ ID NO: 7153 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctctctactgggcctgccagggctgcgtcctaaccggcgtcttggtcatagcccacgagtgcggccaccacgccttcagcgactac

SEQ ID NO: 7154 - DNA, 345 bp, Artificial
  Mutation in BnaA.FAD2.a introduced by TALE nuclease pair BnFAD2_T01
caggatccatgggtgcaggtggaagaatgcaagtctctcctccctccaaataccccgaaaccgacaacctcaaacgcgtaccctgcgagacaccccccttcactgtcggagaactcaagaaagcaatcccaccgcactgtttcaaacgctcgatccctcgctctttctcctacctcatctgcgacatcatcatctcctcctgcctctactacgtcgccaccacctacttccctctcctccctcaccctctcccctaggcctctctactgggcctgccagggctgcgtcctaacgggcgtctgggtcatagcccacgagtgcggccaccacgccttcagcgactac

SEQ ID NO: 7155 - DNA, 343 bp, Artificial
  Mutation in BnaA.FAD2.a introduced by TALE nuclease pair BnFAD2_T01
caggatccatgggtgcaggtggaagaatgcaagtgtctcatccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaaccggcgtctgggtcatagcccgcgagtgcggccaccacgccttcagcgactac

SEQ ID NO: 7156 - DNA, 349 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttatcctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagtgcggccaccacgccttcagcgactac

SEQ ID NO: 7157 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctaacctggcctctctactgggcctgccaaggctgcgtcctaacgggcctctgggtcatagcccacgagtgcggccaccacgccttcagcgactac

SEQ ID NO: 7158 - DNA, 355 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcgcctggcctctctactgggcctgccagggctgcgtcctaaccggcgtctgggtcatagcccacgagtgcggccaccacgccttcagcgactac

SEQ ID NO: 7159 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtcctaaccggcgtctgggtcatagcccacgagtgcggccaccacgccttcagcgactac

SEQ ID NO: 7160 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaacccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccaacttggcctctctactgggcctgccagggctgcgtcctaaccgacgtctggggcatagcccacgagtgcggccaccgcgccatcagcgactgc

SEQ ID NO: 7161 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctcgcctggcctctctactgggcctgccaagggtgcgtcctaaccggcgtctgggtcatagcccacgagtgcggccaccacgccttcagcgactac

SEQ ID NO: 7162 - DNA, 347 bp, Artificial
  Mutation in BnaA.FAD2.a introduced by TALE nuclease pair BnFAD2_T01
caggatccatgggtgcaggtggaagaatgcaagtgtctcccccctccaaaaagtctgaaatcgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcgccctctctcctactggcctctctactgggcctgccaagggtgcgtcctaacgggcctctgggtcatcgcccacgaatgcggccaccacgccttcagcgactac

SEQ ID NO: 7163 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcgccctctctcctacttctactgggcctgccagggctgcgtcctaaccggcgtctgggtcagcgcccacgaatgcggccaccacgccttcagcgactac

SEQ ID NO: 7164 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagactccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 7165 - DNA, 342 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccagggctgcgtcctaaccggcgtctgggtcatagcccacgagtgcggccaccacgccttcagcgactac

SEQ ID NO: 7166 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccaccgcactgtttcaaacgctcgatccctcgctctttctcctacctcatctgggacatcatcatagcctcctgcttctactacgtcaccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 7167 - DNA, 348 bp, Artificial
  Mutation in BnaA.FAD2.a introduced by TALE nuclease pair BnFAD2_T01
caggatccatgggtgcaggtggaagaatgcaagtctatcctccctacagctcccccggaaccaacaccctcaaacgcgtcccctgcgagacaccaccattcactctcggagaactcaagaaagcaatcccaccgcactgtttcaaacgctccatcccacgctccttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 7168 - DNA, 355 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccaagggtgcgtcctaaccggcgtctgggtcatagcccacgagtgcggccaccacgccttcagcgactac

SEQ ID NO: 7169 - DNA, 348 bp, Artificial
  Mutation in BnaA.FAD2.a introduced by TALE nuclease pair BnFAD2_T01
caggatccatgggtgcaggtggaagaatgcaagtctctcctccctccaaaagtctgaaaccgacaacctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 7170 - DNA, 339 bp, Artificial
  Mutation in BnaA.FAD2.a introduced by TALE nuclease pair BnFAD2_T01
caggatccatgggtgcaggtggaagcatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccacctcttacttccctctcctccctcaccctctcgcccctctactgggccggcgagggctgcgtccgaaccggcgtctcgttcactgctcacgatggcggccaccacgccattagcaactac

SEQ ID NO: 7171 - DNA, 350 bp, Artificial
  Mutation in BnaA.FAD2.a introduced by TALE nuclease pair BnFAD2_T01
caggatccatgggtgcaggtgaaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgctggcctctctactgggcctgccaagggtgcgtcctaacgggcctctgggtcatcgcccacgaatgcggccaccacgccttcagcgactac

SEQ ID NO: 7172 - DNA, 335 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccagggctgcgtcctaacgggcctctgggtcagcgcccacgaatgcggccaccacgccttcagcgactac

SEQ ID NO: 7173 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctgggcctgccagggctgcgtcctaaccggcgtctgggtcatagcccacgagtgcggcctccacgccttcagcgactac

SEQ ID NO: 7174 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaggggtgcgtcctaaccggcgtctgggtcatagcccacgagtgcggccaccacgccttcagcgactac

SEQ ID NO: 7175 - DNA, 344 bp, Artificial
  Mutation in BnaA.FAD2.a introduced by TALE nuclease pair BnFAD2_T01
caggatccatgggtgcaggtggaagaatgcaagtgtaccctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccaaggctgcgtcctaacgggcctctgggtcatagcccacgagtgcggccaccacgccttcagcgactac

SEQ ID NO: 7176 - DNA, 349 bp, Artificial
  Mutation in BnaA.FAD2.a introduced by TALE nuclease pair BnFAD2_T01
caggatccatgggtgcaggtggaagaatgcaagtgtctcctccatccaaaaagtctgaacccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7177 - DNA, 352 bp, Artificial
  Mutation in BnaA.FAD2.a introduced by TALE nuclease pair BnFAD2_T01
caggatccatgggtgcaggtggaagaatgcaagtgtctcctccgtccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccgccctggcctctctactgggcctgccagggctgcgtcctaaccggcgtctgggtcatagcccacgattgcggccaccacgccttcagcgactac

SEQ ID NO: 7178 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagctactac

SEQ ID NO: 7179 - DNA, 348 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 7180 - DNA, 339 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaacactcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccggcctgccagggctgcgtcctaaccggcgtctgggtcagagcccacgagtgctgccaccacgccttcagcgactac

SEQ ID NO: 7181 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccatctctcctacttggcctctctactgggcctgccagggctgcgtcctaaccggcgtctgggtcatagcccacgagtgcggccaccacgccttcagcgactac

SEQ ID NO: 7182 - DNA, 345 bp, Artificial
  Mutation in BnaA.FAD2.a introduced by TALE nuclease pair BnFAD2_T01
gaggatccatgggtgcaggtggaagaatgcaagtgtctcctgcctccaaaaagtttgaaaccgacaacatcaagcgcgtacccggcgagacaccgcccttcattgtcggagaactcaagaaagcaatcccaccgcactgtttcaaaaactcgatccctcgctctttctcctacctcatctgggacatcatcatagcctcctgcttctactacttcgccaccacttacttccctctcctccctccccctctcacctacgcctctctactgcgcctgactgggctgcgtcctaaccggcgtcttggtcatagcccacgagtgcggccaccacgccatcagcggctac

SEQ ID NO: 7183 - DNA, 347 bp, Artificial
  Mutation in BnaA.FAD2.a introduced by TALE nuclease pair BnFAD2_T01
caggatccatgggtgcaggtggaagaatgcaagtctcacctccctccagctcccccggaaccaacaccatcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacaggcctctctactgggcctgccagggctgcgtcctaaccggcgtctgggtcatagcccacgagtgcggccaccacgccttcagcgactac

SEQ ID NO: 7184 - DNA, 356 bp, Artificial
  Mutation in BnaA.FAD2.a introduced by TALE nuclease pair BnFAD2_T01
caggatccatgggtgcaggtggaagaatgcaagtgtcacatccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccatgccttcagcgactac

SEQ ID NO: 7185 - DNA, 358 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccatctctcctacttcgccgggtctggcctctctactaggcctgccagggctgcgtccgaaccggcgtctgggtcatagcccacgagtgcggccaccacgccttcagcgactac

SEQ ID NO: 7186 - DNA, 345 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctctctactgggcctgccagggctgcgtcctaaccggcgtctgggtcatagcccacgagtgcggccaccacgccttcagcgactac

SEQ ID NO: 7187 - DNA, 331 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacatcgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgggcctgccagggctgcgtcctaaccggcgtctgggtcatagcccacgagtgcggccaccacgccttcagcgactac

SEQ ID NO: 7188 - DNA, 332 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcatgaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccagggctgcgtcctaaccggcgtctgggtcatagcccacgagtgcggccaccacgccttcagcgactac

SEQ ID NO: 7189 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcgcctggcctctctactgggcctgccagggctgcgtcctaaccggcgtctgggtcatagcccacgagtgcggccaccacgccttcagcgactac

SEQ ID NO: 7190 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctccgacttcctctctactgggcctgccagggctgcgtcctaacgggcctctgggtcatagcccacgagtgcgtccaccacgccttcagcgactac

SEQ ID NO: 7191 - DNA, 351 bp, Artificial
  Mutation in BnaA.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaagcgctcgatccctcgctctttctcctacctcatctgggacatcatcatagcctcctgcttctactacgtcgccaccacttacttccctctcctccctcaccctctctcctacgtcgtggcctctctactgggcctgccagggctgcgtcctaaccggcgtctgggtcatagcccacgagtgcggccaccacgccttcagcgactac

SEQ ID NO: 7192 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactacgcggcctctctactgggcctgccaagggtgcgtcctaaccggcgtctgggtcatagcccacgagtgcggccaccacgccatcagcgactac

SEQ ID NO: 7193 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttactgggcctgccagggctgcgtcctaaccggcgtctgggtcagagcccacgagtgcggccaccacgccttcagcgactac

SEQ ID NO: 7194 - DNA, 344 bp, Artificial
  Mutation in BnaA.FAD2.a introduced by TALE nuclease pair BnFAD2_T01
caggatccatgggtgcaggtggaagaatgcaagtctctcctccctccagctcccccggaaccagcaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgggcctgccagggctgcgtcctaaccggcgtctgggtcatagcccacgagtgcggccaccacgccttcagcgactac

SEQ ID NO: 7195 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccaccattcactctcggagacctcaagaaagcaatcccacctcactgcttcaaacgctcgatccctcgctctttctcctacctcatctgtgacatcatcatagcctcctgcttctactacgtcgccaccacttacttccctctcctccctcaccctctctcctacttggcctctctactgggcctgccaagggtgcgtcctaacgggcctctgggtcatcgcccacgagtgcggccaccacgccttcagcgactac

SEQ ID NO: 7196 - DNA, 357 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcgcctggcctctctactgggcctgccagggctgcgtcctaacgggcctctgggtcatcgcccacgaatgcggccaccacgccttcagcgactac

SEQ ID NO: 7197 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaacgggcctctgggtcatcgcccacgaatgcggccaccacgccttcagcgactac

SEQ ID NO: 7198 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaaggctgcgtcctaaccggcgtctgggtcatagcccacgagtgcggccaccacgccttcagcgactac

SEQ ID NO: 7199 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaacctacaacatcaaactcgtaccctgcgagacaccgcccttcactgtcggagaactcaagaaagcaatcccaccgcactgtttcaaacgctcgatcccccgctctttctcctacctcatctgggacatcatcatagcctcctgcttctactacgtcgccaccacttacttccctctcctccctcacccactctctactgggcctgccagggctgcgtcctaaccggcgtctgggtcatagcccacgagtgcggccaccacgccttcagcgactac

SEQ ID NO: 7200 - DNA, 324 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcttgccaagggtgcgtcctaaccggcgtctgggtcatagcccacgagtgcggccaccacgccgtcagcgactac

SEQ ID NO: 7201 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccaagggtgcgtcctaaccggcgtctgggtcatagcccgcgagtgcggccaccacgccttcagcgactac

SEQ ID NO: 7202 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccatcagcgactac

SEQ ID NO: 7203 - DNA, 330 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctatactgggcctgccaagggtgcgtcctaaccggcgtctgggtcatagcccacgagtgcggccaccacgccttcagcgactac

SEQ ID NO: 7204 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccatgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccgcctggcctctctactgggcctgccaagggtgcgtcctaaccggcgtctgggtcatagcccacgagtgcggccaccacgccttcagcgactac

SEQ ID NO: 7205 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaatagtctgaaaccgacaacctcaagcgcgtaccctgcgagacaccgcccttcactgtcggagaactcaagaaagcaatcccaccgcactgtttcaaacgctccatccctccctctttctcctccctcatcttggtcctcctcataccctccttcttctactacctcgccaccacttacctccccctcctccctctccctctctccgcctggcctctctactgggcctgccaagggtgcgtcctaacgggcgtctgggtcatcgcccacgaatgcggccaccacgccttcagcgactac

SEQ ID NO: 7206 - DNA, 349 bp, Artificial
  Mutation in BnaA.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagtgcggccaccacgccttcagcgactac

SEQ ID NO: 7207 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtgccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 7208 - DNA, 352 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccccccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccagggctgcgtcctaaccggcgtctgggtcatagcccacgagtgcggccaccacgccttcagcgactac

SEQ ID NO: 7209 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgctggcctctctactgggcctgccagggctgcgtcctaaccggcgtctgggtaatagcccacgagtgcggccaccacgccttcagcgactac

SEQ ID NO: 7210 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtactaacgggcctctgggtcatagcccacgagtgcggccaccacgccttcagcgactac

SEQ ID NO: 7211 - DNA, 414 bp, Artificial
  Mutation in BnaA.FAD2.a introduced by TALE nuclease pair BnFAD2_T01
caggatccatgggtgcaggtcgaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccggcaaaaccgcgccgaaggatgtcgctgccgactgggcaatggagcgcctgccggcccacctggcctctctactgggcctgccaagggtgcgtcctaaccggcgtctgggtcatagcccacgagtgcggccaccacgccttcagcgactac

SEQ ID NO: 7212 - DNA, 346 bp, Artificial
  Mutation in BnaA.FAD2.a introduced by TALE nuclease pair BnFAD2_T01
caggatccatgggtgcaggtggaagaatgcaagtgtcccctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcctctctactgggcctgccagggctgcgtcctaaccggcgtctgggtcatagcccacgagtgcggccaccacgccttcagcgactac

SEQ ID NO: 7213 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgggtctggcctctctactaggcctgccagggctgcgtcctaaccggcgtctgggtcatagcccacgagtgcggcctccgcgccttgagcgactac

SEQ ID NO: 7214 - DNA, 348 bp, Artificial
  Mutation in BnaA.FAD2.a introduced by TALE nuclease pair BnFAD2_T01
caggatccatgggtgcaggtggaagaatgcaagtgtctcctccctacaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 7215 - DNA, 347 bp, Artificial
  Mutation in BnaA.FAD2.a introduced by TALE nuclease pair BnFAD2_T01
caggatccatgggtgcaggtagaagaatgcaagtgtctcctacctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 7216 - DNA, 354 bp, Artificial
  Mutation in BnaA.FAD2.a introduced by TALE nuclease pair BnFAD2_T01
caggatccatgggtgcaggtggaagaatgcaagtgtctcctccatccaaaaagtctgaacccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttggcctctctactgggcctgccagggctgcgtcctaaccggcgtctgggtcatagcccacgagtgcggccaccacgccttcagcgactac

SEQ ID NO: 7217 - DNA, 341 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctactgggcctgccagggctgcgtcctaaccggcgtctggttcatagcccacgagtgcggccaccacgccttcagcgactac

SEQ ID NO: 7218 - DNA, 350 bp, Artificial
  Mutation in BnaA.FAD2.a introduced by TALE nuclease pair BnFAD2_T01
caggatccatgggtgcaggtgaaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 7219 - DNA, 334 bp, Artificial
  Mutation in BnaA.FAD2.a introduced by TALE nuclease pair BnFAD2_T01
caggatccatgggtgcagggggaagaatgcaagtctcccctccctccagctcccccgaacccaaaacactcaaacgcgtcccccgcgagacaccacccttcactctcggagacctcaagaaagcaatcccaccgcactgtttcaaacgctcgatccctcgctctttctcctacctcatctgggccatcatcatagcctcctgcttctcctacgtcgccaccacttacttccctctcctccctcaccctctctctactgggcctgccagggctgcgtcctaaccggcgtctgggtcatagcccacgagtgcggccaccacgccttcagcgactac

SEQ ID NO: 7220 - DNA, 332 bp, Artificial
  Mutation in BnaA.FAD2.a introduced by TALE nuclease pair BnFAD2_T01
caggatccatgggtgcagggggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccccctcctccctcaccctctctactgggcctgccaaggctgcgtcctaacgggcctctgggtcagcgcccacgaatgcggccaccacgccttcagcgactac

SEQ ID NO: 7221 - DNA, 323 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaagggtgcgtcctaaccggcgtctgggtcatagcccacgagtgcggccaccacgccttcagcgactac

SEQ ID NO: 7222 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttgcctctcctccctcaccctctctcctactgcgtggcctctctactgggcctgccagggctgcgtcctaaccggcgtctgggtcatagcccacgagtgcggccaccacgccttcagcgactac

SEQ ID NO: 7223 - DNA, 347 bp, Artificial
  Mutation in BnaA.FAD2.a introduced by TALE nuclease pair BnFAD2_T01
caggatccatgggtgcagggggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccctctctactgggcctgccagggctgcgtcctaaccggcgtctgggtcatagcccacgagtgcggccaccacgccttcagcgactac

SEQ ID NO: 7224 - DNA, 329 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccatgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaaccggcgtctgggtcatagcccacgagtgcggccaccacgccttcagcgactac

SEQ ID NO: 7225 - DNA, 350 bp, Artificial
  Mutation in BnaA.FAD2.a introduced by TALE nuclease pair BnFAD2_T01
caggatccatgggtgcaggtggaagaatgcaagtgtatccttcctccaaaaagtctgaaaccgacaacatcaagcgcgtaccctgcgagacaccacccttcactctcggagacctcaagaaagcaatcccacctcactgcttcaaacgctccatccctcgctctttctcctacctcatctgggacatcatcatcgcctcctgcttctactacgtcgccaccacttacttccctctcctccctcaccctctctcctaccgctggcctctctactgggcctgccaagagtgcgtcctaaccggcgtctgggtcatagcccacgagtgctgccaccgcgccttcagcgactac

SEQ ID NO: 7226 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatccagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 7227 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcacaccgcactgtttcaaacgctcgatccctcgctctttctcctacctcatctgggacatcatcatagcctcctgcttctactacgtcgccaccacttacttccctctcctccctcaccctctctcctacctggcctctctactgggcctgccaagggtgcgtcctaaccggcgtctgggtcatagcccacgagtgcggccaccacgccttcagcgactac

SEQ ID NO: 7228 - DNA, 349 bp, Artificial
  Mutation in BnaA.FAD2.a introduced by TALE nuclease pair BnFAD2_T01
caggatccataggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccttggcctctctactgggcctgccagggctgcgtcctaaccggcgtctgggtcatagcccacgagtgcggccaccacgccttcagcgactac

SEQ ID NO: 7229 - DNA, 349 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccctgggcctctctactgggcctgccaagggtgcgtcctaaccggcgtctgggtcagagcccacgagtgcggccaccacgccttcagcgactac

SEQ ID NO: 7230 - DNA, 349 bp, Artificial
  Mutation in BnaA.FAD2.a introduced by TALE nuclease pair BnFAD2_T01
caggatccatgggtgcaggtggaagaatgcaagtgtctcatccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctagccggcgtctgggtcatagcccacgagtgcggcgaccacgccttcagcgactac

SEQ ID NO: 7231 - DNA, 342 bp, Artificial
  Mutation in BnaA.FAD2.a introduced by TALE nuclease pair BnFAD2_T01
caggatccatggtgcaggtggaagaatgcaagtgtctcctccctcaaagaagtctgaaaccgacaccatcaagcgcgtaccctgcgagacaccgcccttcactgtcggacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggccggccagggctgcgtcctaaccggcgtctgggtcatagcccacgagtgcggccaccacgccttcagcgactac

SEQ ID NO: 7232 - DNA, 346 bp, Artificial
  Mutation in BnaA.FAD2.a introduced by TALE nuclease pair BnFAD2_T01
caggatccatgggtgcaggtggaagaatgcaagtgtctccttcctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaaccggcgtctgggtcatagcccacgagtgcggccaccacgccttcagcgactac

SEQ ID NO: 7233 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggcctgccagggctgcgtcctaacgggcctctgggtcatagcccacgagtgcggccaccacgccttcagcgactac

SEQ ID NO: 7234 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccctcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctgccagggctgcgtcctcaccggcgtctgggtcatagcccacgagtgcggccaccacgccttcagcgactcc

SEQ ID NO: 7235 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 7236 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatggcctctctactgggcctgccaagggtgcgtcctaaccggcgtctgggtcatagcccacgagtgcggccaccacgccttcagcgactac

SEQ ID NO: 7237 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 7238 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 7239 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactactgggcctgccaagggtgcgtcctaaccggcgtctgggtcatagcccacgagtgcggccaccacgccttcagcgactac

SEQ ID NO: 7240 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 7241 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctccttctggcctctctactgggcctgccaagggtgcgtcctaaccggcgtctgggtcatagcccacgagtgcggccaccacgccttcagcgactac

SEQ ID NO: 7242 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctacctcaccctctctcctacttctctactgggcctgccaaggctgcgtcctaacgggcctctgggtcatcgcccacgaatgcggccaccacgccttcagcgactac

SEQ ID NO: 7243 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7244 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccgcctggcctctctactgggcctgccaaggctgcgtcctaacgggcctctgggtcatcgcccacgaatgcggccaccacgccttcagcgactac

SEQ ID NO: 7245 - DNA, 329 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgccaagggtgcgtcctaaccggcgtctgggtcatagcccacgagtgcggccaccacgccttcagcgactac

SEQ ID NO: 7246 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccatgccttcagcgactac

SEQ ID NO: 7247 - DNA, 337 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctactgggcctgccaagggtgcgtcctaaccggcgtctgggtcatagcccacgagtgcggccaccacgccttcagcgactac

SEQ ID NO: 7248 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7249 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaagggtgcgtcctaaccggcgtctgggtcatagcccacgagtgcggccaccacgccttcagcgactac

SEQ ID NO: 7250 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaaccggcgtctgggtcatagcccacgagtgtggccaccacgccttcagcgactac

SEQ ID NO: 7251 - DNA, 374 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccaggcttatcttggacaagaagaagatcgctctctactgggcctgccaagggtgcgtcctaaccggcgtctgggtcatagcccacgagtgcggccaccacgccttcagcgactac

SEQ ID NO: 7252 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 7253 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccgcctggcctctctactgggcctgccaagggtgcgtcctaaccggcgtctgggtcatagcccacgagtgcggccaccacgccttcagcgactac

SEQ ID NO: 7254 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcttacttcgcccctggcctctctactgggcctgccaagggtgcgtcctaaccggcgtctgggtcatagcccacgagtgcggccaccacgccttcagcgactac

SEQ ID NO: 7255 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgtttcaaacgctcgatccctcgctctttctcctacctcatctgggacatcatcatagcctcctgcttctactacgtcgccaccacttacttccctctcctccctcaccctctctcaggcctctctactgggcctgccaagggtgcgtcctaaccggcgtctgggtcatagcccacgagtgcggccaccacgccttcagcgactac

SEQ ID NO: 7256 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 7257 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaaccggcgtctgggtcatagcccacgagtgcggccaccacgccttcagcgactac

SEQ ID NO: 7258 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 7259 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacctcatcatagcctcctgcttctactacgtcgccaccacttacttccctctcctccctcaccctctctcctccccgggcctctctactgggcctgccaagggtgcgtcctaaccggcgtctgggtcatagcccacgagtgcggccaccacgccttcagcgactac

SEQ ID NO: 7260 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccacttcgcctggcctctctactgggcctgccaagggtgcgtcctaaccggcgtctgggtcatagcccacgagtgcggccaccacgccttcagcgactac

SEQ ID NO: 7261 - DNA, 394 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatcccacgctccttctcctcttcgacatcatcatagcctcctgcttctactacgtcgccaccacttacttccctctcctccctcaccctctctcctacttcgccataacctgccaggcatcaaactaagcagaaggccatccgtccataggctggcccctctactgggcctgccaaggctgcgtcctaacgggcctctgggtcatcgcccacgaatgcggccaccacgccttcagcgactac

SEQ ID NO: 7262 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgccttcagcgactac

SEQ ID NO: 7263 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaaccggcgtctgggtcatagcccacgagtgcggccaccacgccttcagcgactac

SEQ ID NO: 7264 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 7265 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccacaacgccttcagcgactac

SEQ ID NO: 7266 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 7267 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcggctctctactgggcctgccaagggtgcgtcctaaccggcgtctgggtcatagcccacgagtgcggccaccacgccttcagcgactac

SEQ ID NO: 7268 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgtggccaccacgccttcagcgactac

SEQ ID NO: 7269 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctctatccctcgctctttctcctacctcatctgggacatcatcatagcctcctgcttctactatgtcgccaccacttacttccctctcctccctcaccggtttgcgtattgccggtgcctggcctctctactgggcctgccaagggtgcgtcctaaccggcgtctgggtcatagcccacgagtgcggccaccacgccttcagcgactac

SEQ ID NO: 7270 - DNA, 395 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcaaactcttcctggctagcggtacgcgtattaattgcgtcctggcctctctactgggcctgccaagggtgcgtcctaaccggcgtctgggtcatagcccacgagtgcggccaccacgccttcagcgactac

SEQ ID NO: 7271 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccccactgtttcaaacgctcgatccctcgctctttctcctacctcatctggcacatcatcctaccctcctgctcctactaccccgccaccacttacttccccctcctccctcaccctctcgcctagcctctctactgggcctgccaagggtgcgtcctaaccggcgtctgggtcatagcccacgagtgcggccaccacgccttcagcgactac

SEQ ID NO: 7272 - DNA, 277 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacgccttcagcgactac

SEQ ID NO: 7273 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 7274 - DNA, 300 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccaagggtgcgtcctaaccggcgtctgggtcatagcccacgagtgcggccaccacgccttcagcgactac

SEQ ID NO: 7275 - DNA, 356 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 7276 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaaggaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 7277 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggggcctctctactgggcctgccaagggtgcgtcctaaccggcgtctgggtcatagcccacgagtgcggccaccacgccttcagcgactac

SEQ ID NO: 7278 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcattgcctcctgcttctactacgtcgccaccacttacttccctctcctccctcaccctctctcctactttggcctctctactgggcctgccaagggtgcgtcctaaccggcgtctgggtcatagcccacgagtgtggccaccacgccttcagcgactac

SEQ ID NO: 7279 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctggcctctctactgggcctgccaagggtgcgtcctaaccggcgtctgggtcatagcccacgagtgcggccaccacgccttcagcgactac

SEQ ID NO: 7280 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgcctctctactgggcctgccaagggtgcgtcctaaccggcgtctgggtcatagcccacgagtgcggccaccacgccttcagcgactac

SEQ ID NO: 7281 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcagcctctctactgggcctgccaagggtgcgtcctaaccggcgtctgggtcatagcccacgagtgcggccaccacgccttcagcgactac

SEQ ID NO: 7282 - DNA, 358 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctaacctggcctctctactgggcctgccaaggctgcgtcctaacgggcctctgggtcatcgcccacgaatgcggccaccacgccttcagcgactac

SEQ ID NO: 7283 - DNA, 323 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagggtgcgtcctaaccggcgtctgggtcatagcccacgagtgcggccaccacgccttcagcgactac

SEQ ID NO: 7284 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccctcgcggcctctctactgggcctgccaagggtgcgtcctaaccggcgtctgggtcatagcccacgagtgcggccaccacgccttcagcgactac

SEQ ID NO: 7285 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgcttgatccctcgctctttctcctacctcatctgggacatcatcatagcctcctgcttctactacgtcgccaccacttacttccctctcctccctcaccctctctctctctactgggcctgccaagggtgcgtcctaaccggcgtctgggtcatagcccacgagtgcggccaccacgccttcagcgactac

SEQ ID NO: 7286 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctccttcttctactacgtcgccaccacttccttccctctcctccctctccctctctcctcccctggcccctctactgggcctgccaagggtgcgtcctaaccggcgtctgggtcatagcccacgagtgcggccaccacgccttcagcgactac

SEQ ID NO: 7287 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaaggctgcgtcctaacgggcctctgggtcatagcccacgagtgcggccaccacgccttcagcgactac

SEQ ID NO: 7288 - DNA, 393 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctcacctacactgggcctttcgttttatctgttgtttgtcggtgaacgctcaccttggcctctctactgggcctgccaagggtgcgtcctaaccggcgtctgggtcatagcccacgagtgcggccaccacgccttcagcgactac

SEQ ID NO: 7289 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 7290 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaacgggcctctgggtcatagcccacgagtgcggccaccacgccttcagcgactac

SEQ ID NO: 7291 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcctctctactgggcctgccaagggtgcgtcctaaccggcgtctgggtcatagcccacgagtgcggccaccacgccttcagcgactac

SEQ ID NO: 7292 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctaatgggcctgccaagggtgcgtcctaaccggcgtctgggtcatagcccacgagtgcggccaccacgccttcagcgactac

SEQ ID NO: 7293 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccaagggtgcgtcctaaccggcgtctgggtcatagcccacgagtgcggccaccacgccttcagcgactac

SEQ ID NO: 7294 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaaggctgcgtcctaacgggcctctgggtcatcgcccacgaatgcggccaccacgccttcagcgactac

SEQ ID NO: 7295 - DNA, 351 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcctctctactgggcctgccaagggtgcgtcctaaccggcgtctgggtcatagcccacgagtgcggccaccacgccttcagcgactac

SEQ ID NO: 7296 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatcccacgctctttctcctacctcatctgggacatcatcatagcctcctgcttctactacgtcgccaccacttacttccctctcctccctcaccctctcccctagcctctctactgggcctgccaagggtgcgtcctaaccggcgtctgggtcatagcccacgagtgcggccaccacgccttcagcgactac

SEQ ID NO: 7297 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaacgggcctctgggtcatagcccacgagtgcggccaccacgccttcagcgactac

SEQ ID NO: 7298 - DNA, 354 bp, Artificial
  Mutation in BnaC.FAD2.a introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggtggcctctctactgggcctgccaagggtgcgtcctaaccggcgtctgggtcatagcccacgagtgcggccaccacgccttcagcgactac

SEQ ID NO: 7299 - DNA, 340 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccaaggctgcgtcctaacgggcctctgggtcatagcccacgagtgcggccaccacgccttcagcgactac

SEQ ID NO: 7300 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttaaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7301 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatcccacgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 7302 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccaagggtgcgtcctaaccggcgtctgggtcatagcccacgagtgcggccaccacgccttcagcgactac

SEQ ID NO: 7303 - DNA, 321 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaaccggcgtctgggtcatagcccacgagtgcggccaccacgccttcagcgactac

SEQ ID NO: 7304 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttggcctctctactgggcctgccaagggtgcgtcctaaccggcgtctgggtcatagcccacgagtgcggccaccacgccttcagcgactac

SEQ ID NO: 7305 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccaaggctgcgtcctaacgggcgtctgggtcatagcccacgagtgcggccaccacgccttcagcgactac

SEQ ID NO: 7306 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcacgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 7307 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaaccggcgtctgggtcatagcccacgagtgcggccaccacgccttcagcgactac

SEQ ID NO: 7308 - DNA, 345 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccatcgctctttctcctacctcatctgggacatcatcatagcctcctgcttctactacgtcgccaccacttacttccctctcctccctcaccctctctccctggcctctctactgggcctgccaagggtgcgtcctaaccggcgtctgggtcatagcccacgagtgcggccaccacgccttcagcgactac

SEQ ID NO: 7309 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 7310 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccctggcctctctactgggcctgccaagggtgcgtcctaaccggcgtctgggtcatagcccacgagtgcggccaccacgccttcagcgactac

SEQ ID NO: 7311 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtggcctctctactgggcctgccaaggctgcgtcctaacgggcctctgggtcatcgcccacgaatgcggccaccacgccttcagcgactac

SEQ ID NO: 7312 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatcgcccacgaatgcggccaccacgccttcagcgactac

SEQ ID NO: 7313 - DNA, 321 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagtaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaaccggcgtctgggtcatcgcccacgaatgcggccaccacgccttcagcgactac

SEQ ID NO: 7314 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgtggcctctctactgggcctgccaagggtgcgtcctaacgggcctctgggtcatcgcccacgaatgcggccaccacgccttcagcgactac

SEQ ID NO: 7315 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcgcgactac

SEQ ID NO: 7316 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctggcctctctactgggcctgccaagggtgcgtcctaaccggcgtctgggtcatagcccacgagtgcggccaccacgccttcagcgactac

SEQ ID NO: 7317 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctacttggcctgccaagggtgcgtcctaaccggcgtctgggtcatagcccacgagtgcggccaccacgccttcagcgactac

SEQ ID NO: 7318 - DNA, 349 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7319 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactaaagaaagcaatcccaccgcactgtttcaaacgctcgatccctcgctctttctcctacctcagcagggacatcatcatagcctcctgcttctactacgtcgccaccacttacttccctctcctccctccccctctctcctctctctactgggcctgccaagggtgcgtcctaaccggcgtctgggtcatagcccacgagtgcggccaccacgccttcagcgactac

SEQ ID NO: 7320 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgccttcagcgactac

SEQ ID NO: 7321 - DNA, 277 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcacgccttcagcgactac

SEQ ID NO: 7322 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 7323 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaacgggcctctgggtcatcgcccacgaatgcggccaccacgccttcagcgactac

SEQ ID NO: 7324 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcttggcctctctactgggcctgccaagggtgcgtcctaaccggcgtctgggtcatagcccacgagtgcggccaccacgccttcagcgactac

SEQ ID NO: 7325 - DNA, 346 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctaccacctctccacagcctacttccctctcctcccccaccctctctcctatggcctctctactgggcctgccaagggtgcgtcctaaccggcgtctgggtcatagcccacgagtgcggccaccacgccttcagcgactac

SEQ ID NO: 7326 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctgccaagggtgcgtcctaaccggcgtctgggtcatagcccacgagtgcggccaccacgccttcagcgactac

SEQ ID NO: 7327 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctctatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgagtgcggccaccacgccttcagcgactac

SEQ ID NO: 7328 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagcgtgcgtcctaaccggcgtctgggtcatagcccacgagtgcggccaccacgccatcagcgactac

SEQ ID NO: 7329 - DNA, 347 bp, Artificial
  Mutation in BnaC.FAD2.a introduced by TALE nuclease pair BnFAD2_T01
caggatcaatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattggcctctctactgggcctgccaagggtgcgtcctaaccggcgtctgggtcatagcccacgagtgcggccaccacgccttcagcgactac

SEQ ID NO: 7330 - DNA, 387 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgccatcgtggctggcgatggccaccacctgctcctggcctctctactgggcctgccaagggtgcgtcctaaccggcgtctgggtcatagcccacgaatgcggccaccacgccttcagcgactac

SEQ ID NO: 7331 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgccgccaccacttacttccctctcctccctcaccctctctcctacttctctactgggcctgccaagggtgcgtcctaacgggcctctgggtcatcgcccacgaatgcggccaccacgccttcagcgactac

SEQ ID NO: 7332 - DNA, 300 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaaccccaccgcactgtttcaaacgctcgatccctcgctctttctcctacctcatctgggacatcatcatagcctcctgcttctactacgtctctctactgggcctgccaagggtgcgtcctaaccggcgtctgggtcatagcccacgagtgcggccaccacgccttcagcgactac

SEQ ID NO: 7333 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgccttggcctctctactgggcctgccaagggtgcgtcctaaccggcgtctgggtcatagcccacgagtgcggccaccacgccttcagcgactac

SEQ ID NO: 7334 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaaggctgcgtcctaacgggcctctgggtcatagcccacgagtgcggccaccacgccttcagcgactac

SEQ ID NO: 7335 - DNA, 358 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctcgcctggcctctctactgggcctgccaagggtgcgtcctaaccggcgtctgggtcatagcccacgagtgcggccaccacgccttcagcgactac

SEQ ID NO: 7336 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttctctgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctcgtggtggcctctctactgggcctgccaagggtgcgtcctaaccggcgtctgggtcatagcccacgagtgcggccaccacgccttcagcgactac

SEQ ID NO: 7337 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccaagggtgcgtcctaacgggcctctgggtcatagcccacgagtgcggccaccacgccttcagcgactac

SEQ ID NO: 7338 - DNA, 438 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccagctgggccttgtagttgcccttgaagtggccggacacgaacaggaacttgaactcggtcacgctggaggggtacaccttccacctggcctctctactgggcctgccaagggtgcgtcctaaccggcgtctgggtcatagcccacgagtgcggccaccacgccttcagcgactac

SEQ ID NO: 7339 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcgcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7340 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttggcctctctactgggcctgccaagggtgcgtcctaaccggcgtctgggtcatagcccacgagtgcggccaccacgccttcagcgactac

SEQ ID NO: 7341 - DNA, 408 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcgagccgaagtttccaaaaggtcgttgatcaaagctcgccgcgttgtttcatcaagccttggcctctctactgggcctgccaagggtgcgtcctaaccggcgtctgggtcatagcccacgagtgcggccaccacgccttcagcgactac

SEQ ID NO: 7342 - DNA, 345 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 7343 - DNA, 345 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgccttcagcgactac

SEQ ID NO: 7344 - DNA, 340 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccaagggtgcgtcctaaccggcgtctgggtcatagcccacgagtgcggccaccacgccttcagcgactac

SEQ ID NO: 7345 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcatggcctctctactgagcctgccaagggtgcgtcctaaccggcgtctgggtcatagcccacgagtgcggccaccacgccttcagcgactac

SEQ ID NO: 7346 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggtgcctggcctctctactgggcctgccaagggtgcgtcctaaccggcgtctgggtcatagcccacgagtgcggccaccacgccttcagcgactac

SEQ ID NO: 7347 - DNA, 307 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccgccacttacttccctctcctccctcaccctctctcctacgtcagcggctgttgccggtgctgtgccaggcccacggcttcagcgactac

SEQ ID NO: 7348 - DNA, 300 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccaagggtgcgtcctaaccggcgtctgggtcatagcccacgagtgcggccaccacgccttcagcgactac

SEQ ID NO: 7349 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaaccggcgtctgggtcatagcccacgagtgcggccaccacgccttcagcgactac

SEQ ID NO: 7350 - DNA, 329 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccaagggtgcgtcctaaccggcgtctgggtcatagcccacgagtgcggccaccacgccttcagcgactac

SEQ ID NO: 7351 - DNA, 358 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctaacctggcctctctactgggcctgccaagggtgcgtcctaaccggcgtctgggtcatagcccacgagtgcggccaccacgccttcagcgactac

SEQ ID NO: 7352 - DNA, 348 bp, Artificial
  Mutation in BnaC.FAD2.a introduced by TALE nuclease pair BnFAD2_T01
caggatccattggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaacgggcgtctgggtcatagcccacgagtgcggccaccacgccttcagcgactac

SEQ ID NO: 7353 - DNA, 339 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccaagggtgcgtcctaaccggcgtctgggtcatagcccacgagtgcggccaccacgccttcagcgactac

SEQ ID NO: 7354 - DNA, 357 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcactcaccctctctcctcctccccccgcctggcctctctactgggcctgccaagggtgcgtcctaaccggcgtctgggtcatagcccacgagtgcggccaccacgccttcagcgactac

SEQ ID NO: 7355 - DNA, 383 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcagcggctgttgccggtgctgtgccaggcccacggcttctctctactgggcctgccaagggtgcgtcctaaccggcgtctgggtcatagcccacgagtgcggccaccacgccttcagcgactac

SEQ ID NO: 7356 - DNA, 324 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcgccaagggtgcgtcctaaccggcgtctgggtcatagcccacgagtgcggccaccacgccttcagcgactac

SEQ ID NO: 7357 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaaccggcgtctgggtcatagcccacgagtgcggccaccacgccttcagcgactac

SEQ ID NO: 7358 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7359 - DNA, 339 bp, Artificial
  Mutation in BnaC.FAD2.a introduced by TALE nuclease pair BnFAD2_T01
caggatccatgagtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgggtcatagcccacgagtgcggccaccacgccttcagcgactac

SEQ ID NO: 7360 - DNA, 339 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgggtcatagcccacgagtgcggccaccacgccttcagcgactac

SEQ ID NO: 7361 - DNA, 358 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctcgcctggcctctctattgggcctgccaagggtgcgtcctaaccggcgtctgggtcatagcccacgagtgcggccatcacgccttcagcgactac

SEQ ID NO: 7362 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 7363 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaaccggcgtctgggtcatagcccacgagtgcggccaccacgccttcagcgactac

SEQ ID NO: 7364 - DNA, 405 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcaattcactgacgggtgccccgctcaacttgaccccccagcaggtggtggccatcggcctctctactgggcctgccaagggtgcgtcctaaccggcgtctgggtcatagcccacgagtgcggccaccacgccttcagcgactac

SEQ ID NO: 7365 - DNA, 349 bp, Artificial
  Mutation in BnaC.FAD2.a introduced by TALE nuclease pair BnFAD2_T01
caggatccatgggtgcaggtggaagaaagcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7366 - DNA, 404 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcggatttgtcctactcaggagagcgttcaccgacaaacaacagataaaacgaaaggcccgcctggcctctctactgggcctgccaagggtgcgtcctaaccggcgtctgggtcatagcccacgagtgcggccaccacgccttcagcgactac

SEQ ID NO: 7367 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccccgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccacgagtgcggccaccacgccttcagcgactac

SEQ ID NO: 7368 - DNA, 300 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctcttcctcctacctcatctgggacatcatcatagcctcctgcttctactacgtctctctactgggcctgccaagggtgcgtcctaaccggcgtctgggtcatagcccacgagtgcggccaccacgccttcagcgactac

SEQ ID NO: 7369 - DNA, 347 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacagcatcaagcgcgtaccctgcgaggcaccgcccttcactgtcggagaactcaagaaagcaatcccaccgcactgtttcaaacgctcgatccctcgctctttctcctacctcatctgggacatcatcatagccacctgcttctactacgtcgccaccacttacttccctctcctccctcaccctctctcctacttacctctctactgggcctgccaagggtgcgtcctaaccggcgtctgggtcatagcccacgagtgcggccaccacgccttcagcgactac

SEQ ID NO: 7370 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaagggtgcgtcctaaccggcgtctgggtcatagcccacgagtgcggccaccacgccttcagcgactac

SEQ ID NO: 7371 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaagggtgcgtcctaaccggcgtctgggtcatagcccacgagtgcggccaccacgccttcagcgactac

SEQ ID NO: 7372 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcagcctctctactgggcctgccaagggtgcgtcctaaccggcgtctgggtcatggcccacgagtgcggccaccacgccttcagcgactac

SEQ ID NO: 7373 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 7374 - DNA, 323 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggccggccaagggtgcgtcctaaccggcgtctgggtcatagcccgcgagcgcggccaccacaccttcagcgactac

SEQ ID NO: 7375 - DNA, 358 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctcgcctggcctctctactgggcctgccaagggtgcgtcctaaccggcgtctgggtcatagcccacgagtgcggccaccacgccttcagcgactac

SEQ ID NO: 7376 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaactctctactgggcctgccaagggtgcgtcctaaccggcgtctgggtcatagcccacgagtgcggccaccacgccttcacgactac

SEQ ID NO: 7377 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctatctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 7378 - DNA, 347 bp, Artificial
  Mutation in BnaC.FAD2.a introduced by TALE nuclease pair BnFAD2_T01
cagggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcctctctactgggcctgccaagggtgcgtcctaaccggcgtctgggtcatagcccacgagtgcggccaccacgccttcagcgactac

SEQ ID NO: 7379 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcacgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 7380 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaacagacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 7381 - DNA, 436 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcgccctggctggcgatggccaccacctgctccggggtcaagccgtgggcctggcatctctgccaaatagttgggagccaatgagggcaggcctctctactgggcctgccaagggtgcgtcctaaccggcgtctgggtcatagcccacgagtgcggccaccacgccttcagcgactac

SEQ ID NO: 7382 - DNA, 329 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctactgccaagggtgcgtcctaaccggcgtctgggtcatagcccacgagtgcggccaccacgccttcagcgactac

SEQ ID NO: 7383 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacgcctctctactgggcctgccaagggtgcgtcctaaccggcgtctgggtcatagcccacgagtgcggccaccacgccttcagcgactac

SEQ ID NO: 7384 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctacgagacaccgcccttcactgtcggagaactcaagaaagcaatcccaccgcactgtttcaaacgctcgatccctcgctctttctcctacctcatctgggacatcatcatagcctcctgcttctactatgtcgccaccacttacttccctctcctccctcaccggtttgcgtattgccggtgcctggcctctctactgggcctgccaagggtgcgtcctaaccggcgtctgggtcatagcccacgagtgcggccaccacgccttcagcgactac

SEQ ID NO: 7385 - DNA, 355 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 7386 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctacctcctcttcgacatcctcgtctcctcctccctctaccacctctccacagcctacttccctctcctccctcaccctctctactgggcctgccaagggtgcgtcctaaccggcgtctgggtcatagcccacgagtgcggccaccacgccttcagcgactac

SEQ ID NO: 7387 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgggcctctctactgggcctgccaagggtgcgtcctaaccggcgtctgggtcatagcccacgagtgcggccaccacgccttcagcgactac

SEQ ID NO: 7388 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaagggtgcgtcctaacgggcctctgggtcatcgcccacgaatgcggccaccacgccttcagcgactac

SEQ ID NO: 7389 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaacgggcctctgggtcatcgcccacgaatgcggccaccacgccttcagcgactac

SEQ ID NO: 7390 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcctggcctctctactgggcctgccaagggtgcgtcctaaccggcgtctgggtcatagcccacgagtgcggccaccacgccttcagcgactac

SEQ ID NO: 7391 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgagtgcggccaccacgccttcagcgactac

SEQ ID NO: 7392 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctaggcctctctactgggcctgccaagggtgcgtcctaacgggcctctgggtcatagcccacgagtgcggccaccacgccctcagcgactac

SEQ ID NO: 7393 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagccaacgagtgcggccaccacgccttcagcgactac

SEQ ID NO: 7394 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctggcctctctactgggcctgccaagggtgcgtcctaaccggcgtctgggtcatagcccacgagtgcggccaccacgccttcagcgactac

SEQ ID NO: 7395 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggcctgccaagggtgcgtcctaaccggcgtctgggtcatagcccacgagtgcggccaccacgccttcagcgactac

SEQ ID NO: 7396 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcataccctgcgagacaccgcccttcactgtcggagaactcaagaaagcaatcccaccgcactgtttcaaacgctcgatccctcgctctttctcctacatcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7397 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaagggtgcgtcctaaccggcgtctgggtcatagcccacgagtgcggccaccacgccttcagcgactac

SEQ ID NO: 7398 - DNA, 347 bp, Artificial
  Mutation in BnaC.FAD2.a introduced by TALE nuclease pair BnFAD2_T01
caggatccatggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 7399 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacgcctggcctctctactgggcctgccaagggtgcgtcctaaccggcgtctgggtcatagcccacgagtgcggccaccacgccttcagcgactac

SEQ ID NO: 7400 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 7401 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccaagactgcgtcctaacgggcctctgggtcatcgcccacgaatgcggccaccacgccttcagcgactac

SEQ ID NO: 7402 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagtgtgcgtcctaaccggcgtctgggtcatagcccacgagtgcggccaccacgccttcagcgactac

SEQ ID NO: 7403 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaactctctactgggcctgccaagggtccgtcctaaccggcgtctgggtcatagcccacgagtgcggccaccacgccttcagcgactac

SEQ ID NO: 7404 - DNA, 380 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcacggtggtccggcgcacgcgctctggaggcctgcctctctactgggcctgccaagggtgcgtcctaaccggcgtctgggtcatagcccacgagtgcggccaccacgccttcagcgactac

SEQ ID NO: 7405 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctaatacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 7406 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcctggcctctctactgggcctgccaagggtgcgtcctaaccggcgtctgggtcatagcccacgagtgcggccaccacgccttcagcgactac

SEQ ID NO: 7407 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcgaccaccacgccttcagcgactac

SEQ ID NO: 7408 - DNA, 350 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttggcctctctactgggcctgccaagggtgcgtcctaaccggcgtctgggtcatagcccacgagtgcggccaccacgccttcagcgactac

SEQ ID NO: 7409 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 7410 - DNA, 356 bp, Artificial
  Mutation in BnaC.FAD2.a introduced by TALE nuclease pair BnFAD2_T01
caggatccatgggtgcaggtggaagaatgcagtgtctcctccctccaagaagtctgaaaccggcaccattaagcgcgtaccctgcgagacaccgcccttcactgtcggagaactcaagaaagcaaacccaccgcactgtttcaaacgctcgatccctcgctctttctcctacctcatcttggacctcatcaatgcctcctgcttctcctatgtcgccaccccttacttccctctcctccctcaccggtttgcgtattgccggtgcctggcctctctactgggcctgccaagggtgcgtcctaaccggcgtctgggtcatagcccacgagtgcggccaccccgccttcagcgactac

SEQ ID NO: 7411 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaagggtgcgtcctaaccggcgtctgggtcatagcccacgagtgcggccaccacgccttcagcgactac

SEQ ID NO: 7412 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccaagggtgcgtcctaaccggcgtctgggtcatagcccacgagtgcggccaccacgccttcagcgactac

SEQ ID NO: 7413 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgctac

SEQ ID NO: 7414 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctttggcctctctactgggcctgccaagggtgcgtcctaaccggcgtctgggtcatagcccacgagtgcggccaccacgccttcagcgactac

SEQ ID NO: 7415 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaagggtgcgtcctaaccggcgtctgggtcatcgcccacgaatgcggccaccacgccttcagcgactac

SEQ ID NO: 7416 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttcccactcctccctcaccctctctcctactttggcctctctactgggcctgccaagggtgcgtcctaaccggcgtctgggtcatagcccacgagtgcggccaccacgccttcagcgactac

SEQ ID NO: 7417 - DNA, 334 bp, Artificial
  Mutation in BnaC.FAD2.a introduced by TALE nuclease pair BnFAD2_T01
caggatccatgggtgcaggtggaaggatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttcccctacctcatctgggacatcatcatagcctcctgcttctactacgtcgccaccacttacttccctctcctccctcaccctctctctactgggcctgccaagggtgcgtcctaaccggcgtctgggtcatagcccacgagtgcggccaccacgccttcagcgactac

SEQ ID NO: 7418 - DNA, 332 bp, Artificial
  Mutation in BnaC.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctggaactgccaagggtgcgtcctaaccggcgtctgggtcatagcccacgagtgcggccaccacgccttcagcgactac

SEQ ID NO: 7419 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgccctggcctctctactgggcctgccaagggtgcgtcctaacgggcctctgggtcatagcccacgagtgcggccaccacgccttcagcgactac

SEQ ID NO: 7420 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttcctctctactgggcctgccaagggtgcgtcctaaccggcgtctgggacatagcccacgagtgcggccaccacgccttcagcgactac

SEQ ID NO: 7421 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttaccttggcccctctactgggcctgccaaggctgcgtcctaacgggcctctgggtcatcgcccacgaatgcggccaccacgccttcagcgactac

SEQ ID NO: 7422 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtcctaaccggcgtctgggtcatagcccacgagtgcggccaccacgccttcagcgactac

SEQ ID NO: 7423 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccgcctggcctctctactgggcctgccaaggctgcgtcctaacgggcctctgggtcatagcccacgagtgcggccaccacgccttcagcgactac

SEQ ID NO: 7424 - DNA, 340 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccaagggtgcgtcctaaccggcgtctgggtcatagcccacgagtgcggccaccacgccttcagcgactac

SEQ ID NO: 7425 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactggacctgccaagggtgcgtcctaaccggcgtctgggtcatagcccacgagtgcggccaccacgccttcagcgactac

SEQ ID NO: 7426 - DNA, 343 bp, Artificial
  Mutation in BnaC.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 7427 - DNA, 277 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccacgccttcagcgactac

SEQ ID NO: 7428 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccaagggtgcgtcctaaccggcgtctgggtcatcgcccacgaatgcggccaccacgccttcagcgactac

SEQ ID NO: 7429 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 7430 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgcttcaaacgctccatccctcgctctttctcctacctcatctgggacatcatcatagcctcctgcttctactacgtccccacctcttacttccctctcctccctcaccctctctcccacggcctctctactgggcctgccaagggtgcgtcctaaccggcgtctgggtcatagcccacgagtgcggccaccacgccttcagcgactac

SEQ ID NO: 7431 - DNA, 348 bp, Artificial
  Mutation in BnaC.FAD2.a introduced by TALE nuclease pair BnFAD2_T01
caggatccatgggtgcagtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7432 - DNA, 332 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcagcctctctactgggcctgccaagggtgcgtcctaaccggcgtctgggtcatagcccacgagtgcggccaccacgccttcagcgactac

SEQ ID NO: 7433 - DNA, 355 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctacgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccaagggtgcgtcctaaccggcgtctgggtcatagcccacgagtgcggccaccacgccttcagcgactac

SEQ ID NO: 7434 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 7435 - DNA, 329 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgccaagggtgcgtcctaaccggcgtctgggtcatagcccacgagtgcggccaccacgccttcagcgactac

SEQ ID NO: 7436 - DNA, 350 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 7437 - DNA, 389 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccctcaagcgcgtaccctgcgagacaccgcccttcactgtcggagacctcaagaacgcaatcccaccgcactgtttcaaacgctcgatccctcgctctttctcctacctcatctgggacatcatcatagcctcctgcttctactacgtcgccaccacttacttccctctcctccctcaccacccacgtataaaccgtcgatgccctgctgaatattgaacggaaccaggcgactggcctctctactgggcctgccaagggtgcgtcctaaccggcgtctgggtcatagcccacgagtgcggccaccacgccgtcagcgactac

SEQ ID NO: 7438 - DNA, 393 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacactgggcctttcgttttatctgttgtttgtcggtgaacgctctccttggcctctctactgggcctgccaagggtgcgtcctaaccggcgtctgggtcatagcccacgagtgcggccaccacgccttcagcgactac

SEQ ID NO: 7439 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctacgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 7440 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacgtctctctactgggcctgccaagggtgcgtcctaaccggcgtctgggtcatagcccacgagtgcggccaccacgccttcagcgactac

SEQ ID NO: 7441 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccaagggtgcgtcctaaccggcgtctgggtcatagcccacgagtgcggccaccacgccttcagcgactac

SEQ ID NO: 7442 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaacgggcctctgggtcatagcccacgagtgcggccaccacgccttcagcgactac

SEQ ID NO: 7443 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgtcctaaccggcgtctgggtcatagcccacgagtgcggccaccacgccttcagcgactac

SEQ ID NO: 7444 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggtggcctctctactgggcctgccaagggtgcgtcctaaccggcgtctgggtcatagcccacgagtgcggccaccacgccttcagcgactac

SEQ ID NO: 7445 - DNA, 407 bp, Artificial
  Mutation in BnaC.FAD2.a introduced by TALE nuclease pair BnFAD2_T01
caggaccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgagccgaagtttccaaaaggtcgttgatcaaagctcgccgcgttgtttcatcaagccttggcctctctactgggcctgccaagggtgcgtcctaaccggcgtctgggtcatagcccacgagtgcggccaccacgccttcagcgactac

SEQ ID NO: 7446 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcgcctggcctctctactgggcctgccaagggtgcgtcctaaccggcgtctgggtcatagcccacgagtgcggccaccacgccttcagcgactac

SEQ ID NO: 7447 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaaacgcgtcccctgcgagacaccacccttcactctcggagacctcaagaaagcaatcccacctcactgcttcaaacgctccatccctcgctccttctcctacctcctctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 7448 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 7449 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagaaaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtctggcctctctactgggcctgccaagggtgcgtcctaaccggcgtctgggtcatagcccacgagtgcggccaccacgccttcagcgactac

SEQ ID NO: 7450 - DNA, 329 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctctaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgccaagggtgcgtcctaaccggcgtctgggtcatagcccacgagtgcggccaccacgccttcagcgactac

SEQ ID NO: 7451 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaagggtgtgtcctaaccggcgtctggatcatagcccacgagtgcggccaccacgccttcagcgactac

SEQ ID NO: 7452 - DNA, 403 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcatacctctccgccttgctcccttcgggaagcgtggcgctttctcatagctcaggcctctctactgggcctgccaagggtgcgtcctaaccggcgtctgggtcatagcccacgagtgcggccaccacgccttcagcgactac

SEQ ID NO: 7453 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcgcctggcctctctactgggcctgccaagggtgcgtcctaaccggcgtctgggtcatagcccacgagtgcggccaccacgccttcagcgactac

SEQ ID NO: 7454 - DNA, 358 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttcgcctaacctggcctctctactgggcctgccaagggtgcgtcctaaccggcgtctgggtcatagcccacgagtgcggccaccacgccttcagcgactac

SEQ ID NO: 7455 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccaagggtgcgtcctaaccggcgtctgggtcatagcccacgagtgcggccaccacgccttcagcgactac

SEQ ID NO: 7456 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7457 - DNA, 343 bp, Artificial
  Mutation in BnaC.FAD2.a introduced by TALE nuclease pair BnFAD2_T01
caggatccatgggtgcaggtgcaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccccttacttccctctcctccctcaccctctctcctacttctctactgggcctgccaagggtgcgtcctaaccggcgtctgggtcatagcccacgagtgcggccaccaggcctttagcgactac

SEQ ID NO: 7458 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcacctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 7459 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacctccgcctggcctctctactgggcctgccaagggtgcgtcctaaccggcgtctgggtcatagcccacgagtgcggccaccacgccttcagcgactac

SEQ ID NO: 7460 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaaggctgcgtcctaacgggcctctgggtcatcgcccacgaatgcggccaccacgccttgagcgactac

SEQ ID NO: 7461 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatctctactgggcctgccaagggtgcgtcctaaccggcgtctgggtcatagcccacgagtgcggccaccacgccttcagcgactac

SEQ ID NO: 7462 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaacgggcgtctgggtcatcgcccacgaatgcggccaccacgccttcagcgactac

SEQ ID NO: 7463 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaactctctactgggcctgccaagggtgcgtcctaaccggcgtctgggtcatagcccacgagtgcggccaccacgccttcagcgactac

SEQ ID NO: 7464 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcccctggcctctctactgggcctgccaagggtgcgtcctaaccggcgtctgggtcatagcccacgagtgcggccaccacgccatcagcgactac

SEQ ID NO: 7465 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcccctctactgggcctgccaaggctgcgtcctaacgggcctctgggtcatcgcccacgagtgcggccaccacgccttcagcgactac

SEQ ID NO: 7466 - DNA, 424 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggataactcaagaaagcaatcccaccgcactgtttcaaacgctcgatccctcgctctttctcctacctcatctgggacatcatcatagcctcctgcttctactacgtcgccaccacttacttccctctcctccctcaccctctcccctcctcctccaccgccggcttgccgccatcgtggctggcgctggccaccacctgctggggggtcaagccgtgggcctggcatggcctctctactgggcctgccaagggtgcgtcctaaccggcgtctgggtcatagcccacgagtgcggccaccacgccttcagcgactac

SEQ ID NO: 7467 - DNA, 336 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaacatcaagcgcgtaccctgcgagacaccgcccttcactgtcggagaactcaagaaagcaatcccaccgcactgtttaaaacgctcgatccctcgctctttctcctacctcatctgggacatcatcatagcctcctgcttctactacgtcgccaccacttacttccctctcctccctcaccctctctctctactgggcctgccaagggtgcgtcctaaccggcgtctgggtcatagcccacgagtgcggccaccacgccttcagcgactac

SEQ ID NO: 7468 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgtgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaagggtgcgtcctaaccggcgtctgggtcatagcccacgagtgcggccaccacgccttcagcgactac

SEQ ID NO: 7469 - DNA, 350 bp, Artificial
  Mutation in BnaC.FAD2.a introduced by TALE nuclease pair BnFAD2_T01
caggatacatgggtgcaggtggaagaatgcaagtctctcctccctccagctcccccgaaaccaaaaccctcaaacgcgtcccctgcgagacaccacccttcactcttggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagcgtgcgtcctaaccggcgtctgggtcatagcccgcgagtgctgccaccacgccatcagcgactac

SEQ ID NO: 7470 - DNA, 318 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccaagggtgcgtcctaaccggcgtctgggtcatagcccacgagtgcggccaccacgccttcagcgactac

SEQ ID NO: 7471 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacacagcccttcactgtcggagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 7472 - DNA, 323 bp, Artificial
  Mutation in BnaC.FAD2.a introduced by TALE nuclease pair BnFAD2_T01
caggatccagggtgcaggtggcagaatgtaagtgtctcttccctccacgaagtatgaaaccgacaccatcaagcgcgtaccctgcgagacaccgcccttcactgtcggagaactcaagaaaccaatcccaccgcactgtttcaaacgctcggtccatcgctctttctcctacctcatctgggacatcatcatagcctactgcttctactacgtccccacctcttacttccctctcctcccccaccctctcccgccaaggatgcatccaaagcggcttcttgtacataacccaccagtgcggccactgcgccttctgcgactac

SEQ ID NO: 7473 - DNA, 344 bp, Artificial
  Mutation in BnaC.FAD2.a introduced by TALE nuclease pair BnFAD2_T01
caggatccatgggtgcaggtggaagaatgcaagtgtctcctcctccaagaagtctgaaaccgacaacatcaagcgcgtaccctgcgagaccccccccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 7474 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 7475 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaatggcctctctactgggcctgccaagggtgcgtcctaaccggcgtctgggtcatagcccacgagtgcggccaccacgccttcagcgactac

SEQ ID NO: 7476 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgcaaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7477 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgttggcctctctactgggcctgccaagggtgcgtcctaacgggcctctgggtcatagcccacgagtgcggcctccacgccttcagcgactac

SEQ ID NO: 7478 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactggacctgccaagggtgcgtcctaaccggcgtctgggtcatagcccacgagtgcggccaccacgccttcagcgactac

SEQ ID NO: 7479 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccaccgcctctctactgggcctgccaagggtgcgtcctaaccggcgtctgggtcatagcccacgagtgcggccaccacgccttcagcgactac

SEQ ID NO: 7480 - DNA, 334 bp, Artificial
  Mutation in BnaC.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctgccaagcgtgcgtcctaaccggcgtctgggtcatagcccacgagtgcggccaccacgccttcagcgactac

SEQ ID NO: 7481 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctggcccctctactgggcctgccaaggctgcgtcctaacgggcctctgggtcatcgcccacgaatgcggccaccacgccttcagcgactac

SEQ ID NO: 7482 - DNA, 351 bp, Artificial
  Mutation in BnaC.FAD2.a introduced by TALE nuclease pair BnFAD2_T01
caggatccatgggtgcaggtggaagaatgtaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaaccggcgtctgggtcatagcccacgagtgcggccaccacgccttcagcgactac

SEQ ID NO: 7483 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgtcctaacgggcctctgggtcatcgcccacgagtgcggccaccacgccttcagcgactac

SEQ ID NO: 7484 - DNA, 409 bp, Artificial
  Mutation in BnaC.FAD2.a introduced by TALE nuclease pair BnFAD2_T01
caggatccatgggtgcaggtggaagaatgcaagtgtctcctccctcccagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcaaataatgattttattttgactgatagttacctgttcgttgcaacaaattgatgagctctctactgggcctgccaagggtgcgtcctaaccggcttcttggtcatagcccacgagtgcggccaccacgccttcagcgactac

SEQ ID NO: 7485 - DNA, 318 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccaagggtgcgtcctaaccggcgtctgggtcatagcccacgagtgcggccaccacgccttcagcgactac

SEQ ID NO: 7486 - DNA, 347 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 7487 - DNA, 346 bp, Artificial
  Mutation in BnaC.FAD2.a introduced by TALE nuclease pair BnFAD2_T01
caggatccatgggtgcaggtggaagaatgcaagtgtctcctccctcccagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgagtgcggccaccacgccttcagcgactac

SEQ ID NO: 7488 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgttggcctctctactgggcctgccaagggtgcgtcctaaccggcgtctgggtcatagcccacgagtgcggccaccacgccttcagcgactac

SEQ ID NO: 7489 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7490 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgaccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctgggcctgccaagggtgcgtcctaaccggcgtctgggtcatagcccacgagtgcggccaccacgccctcagcgactac

SEQ ID NO: 7491 - DNA, 408 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgagccgaagtttccaaaaggtcgttgatcaaagctcgccgcgttgtttcatcaagccttggcctctctactgggcctgccaagggtgcgtcctaaccggcgtctgggtcatagcccacgagtgcggccaccaagccatcagcgactac

SEQ ID NO: 7492 - DNA, 348 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatggcctctctactgggcctgccaagggtgcgtcctaaccggcgtctgggtcatagcccacgagtgcggccaccacgccttcagcgactac

SEQ ID NO: 7493 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 7494 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgtgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 7495 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatcttggacatcatcatagcctcctgcttctactacgtcgccaccacttacttccctctcctccctccccctctcgcctacgtcgcccctagcctctctacggggcctgccaagggtgcgtcctaaccggcgtcggggtcatagctcacgagtgctgccaccacgccatgaacgactac

SEQ ID NO: 7496 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaacccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 7497 - DNA, 312 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 7498 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgcttcaaacgctccatccctcgctccttctcctacctcatctgggacatcatcatagcctcctgcttctactacgtcgccaccacttacttccctctcctccctcaccctctctccgacgtcctggcctctctactgggccggccaagggtgcgtcctaaccggcgtctgggtcatagcccacgagtgcggccaccacgccttcagcgactac

SEQ ID NO: 7499 - DNA, 331 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcctcagcctctctactgggcctgccaagcgtgcgtcctaaccggcgtctgggtcatagcccacgagtgcggccaccacgccttcagcgactac

SEQ ID NO: 7500 - DNA, 338 bp, Artificial
  Mutation in BnaC.FAD2.a introduced by TALE nuclease pair BnFAD2_T01
caggatccatgggtgcaggtggaagaatgcaagtgtttcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcctgccaagggtgcgtcctaaccggcgtctgggtcatagcccacgagtgcggccaccacgccttcagcgactac

SEQ ID NO: 7501 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctactgcttctactacgtcgccaccacttacttccctctcctccctcaccctctcgcctggcctctctactgggcctgccaatggtgcgtcctaaccggcgtctgggtcatagcccacgagtgcggccaccacgccttcagcgactac

SEQ ID NO: 7502 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaacgggcctctgggtcatcgcccacgaatgcggccaccacgccttcagcgactac

SEQ ID NO: 7503 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 7504 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccaagggtgcgtcctaaccggcgtctgggtcatagcccacgagtgcggccaccacgccttcagcgactac

SEQ ID NO: 7505 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtaatagcccacgagtgcggccaccacgccttcagcgactac

SEQ ID NO: 7506 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcttggcctctctactgggcctgccaagggtgcgtcctaaccggcgtctgggtcatagcccacgagtgcggccaccacgccttcagcgactac

SEQ ID NO: 7507 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcagcctctctactgggcctgccaagggtgcgtcctaacgggcctctgggtcatagcccacgagtgcggccaccacgccttcagcgactac

SEQ ID NO: 7508 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccacgagtgcggccaccacgccttcagcgactac

SEQ ID NO: 7509 - DNA, 350 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgggcctctctactgggcctgccaagggtgcgtcctaaccggcgtctgggtcatagcccacgagtgcggccaccacgccttcagcgactac

SEQ ID NO: 7510 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgtgtcctaaccggcgtctgggtcatagcccacgagtgcggccaccacgccttcagcgactac

SEQ ID NO: 7511 - DNA, 338 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctctttctcctacctcatctgggacatcatcatagcctcctgcttctactacgtcgccaccacttacttccctctcctccctcaccctctccctctctactgggcctgccaagggtgcgtcctaaccggcgtctgggtcatagcccacgagtgcggccaccacgccttcagcgactac

SEQ ID NO: 7512 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacatcgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtccgaaccggcgtctgggtcatagcccacgagtgcggccaccacgccttcagcgactac

SEQ ID NO: 7513 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttcctctctactgggcctgccaagggtgcgtcctaaccggcgtctgggtcatagcccacgagtgcggccaccacgccttcagcgactac

SEQ ID NO: 7514 - DNA, 339 bp, Artificial
  Mutation in BnaC.FAD2.a introduced by TALE nuclease pair BnFAD2_T01
caggatccatgggtgcaggtggaagaatgcaagtctctcatccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgggtcatagcccacgagtgcggccaccacgccatcagcaactac

SEQ ID NO: 7515 - DNA, 332 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggaactgccaagggtgcgtcctaaccggcgtctgggtcatagcccacgagtgcggccaccacgccttcagcgactac

SEQ ID NO: 7516 - DNA, 385 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatcccacgctctttctcctacctcatctgggacatcatcatagcctcctgcttctactacgtcgccaccacttacttccctctcctccccgtgggcctgccacagcaccggcaacagccgctggaccgtctccagcgcctgcctggcctctctactgggcctgccaagggtgcgtcctaaccggcgtctgggtcatagcccacgagtgcggccaccacgccttcagcgactac

SEQ ID NO: 7517 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtcttggtcatagcccacgagtgcggccaccacgccttcagcgactac

SEQ ID NO: 7518 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggccggccaagggtgcgtcctaaccggcgtctgggtcatagcccacgagtgctgccaccacgccttcagcgactac

SEQ ID NO: 7519 - DNA, 277 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgccttcagcgactac

SEQ ID NO: 7520 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgtcctaaccggcgtctgggtcatagcccacgagtgcggccaccacgccatcatcgactac

SEQ ID NO: 7521 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcgcctggcccctctactgggcctgccaaggctgcgtcctaacgggcctctgggtcatcgcccacgaatgcggccaccacgccttcagcgactac

SEQ ID NO: 7522 - DNA, 337 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctactgggcctgccaagggtgcgtcctaaccggcgtctgggtcatagcccacgagtgcggccaccacgccatcagcgactac

SEQ ID NO: 7523 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaataaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccaaggctgcgtcctaacgggcctctgggtcatagcccacgagtgcggccaccacgccttcagcgactac

SEQ ID NO: 7524 - DNA, 408 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgagccgaagtttccaaaaggtcgttgatcaaagctcgccgcgttgtttcatcaagccttggcctctctactgggcctgccaagggtgcgtcctaaccgtcgtctgggtcatagcccacgagtgcggccaccacgccttcagcgactac

SEQ ID NO: 7525 - DNA, 426 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttatggactccaactacctctgatagttgagtcgatacttcggcgatcaccgcttccctcataatgtttaactttgttttggcctctctactgggcctgccaagggtgcgtcctaaccggcgtctgggtcatagcccaccagtgcggccaccacgccttcagcgactac

SEQ ID NO: 7526 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttctctactgggcctgccaagggtgcgtcctaaccggcgtctgggtcatagcccacgagtgcggccaccacgccttcagcgactac

SEQ ID NO: 7527 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 7528 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgctgccaccacgccttcagcgactac

SEQ ID NO: 7529 - DNA, 343 bp, Artificial
  Mutation in BnaC.FAD2.a introduced by TALE nuclease pair BnFAD2_T01
caggatccatgggtgcaggtggaagaatgcaagtctatcctccctcccgctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcatcctgcttctactacgtcgccaccacttacttccctctcctccctcaccctctctctggcctctctactgggcctgccaagggtgcgtcctaaccggcgtctgggtcatagcccaccagtgcggccaccacgccttcagcaactac

SEQ ID NO: 7530 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccggcagcgactac

SEQ ID NO: 7531 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacctacctccctctcctccctcaccccctctcctacgcctggcctctctactgggcctgccaaggctgcgtcctaaccggcgtctgggtcatagcccacgagtgcggccaccacgccttcagcgactac

SEQ ID NO: 7532 - DNA, 389 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccacccacgtataaaccgtcgatgccctgctgaatattgaactgaaccaggcgactggcctctctactgggcctgccaagggtgcgtcctaaccggcgtctgggtcatagcccacgagtgcggccaccacgccttcagcgactac

SEQ ID NO: 7533 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtcggggtcatagcccacgagtgcggccaccacgccttcagcgactac

SEQ ID NO: 7534 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacactgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttcctctctactgggcctgccaagggtgcgtcctaaccggcgtctgggtcatagcccacgagtgcggccaccacgccttcagcgactac

SEQ ID NO: 7535 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcacgactac

SEQ ID NO: 7536 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgccccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttgggcctctctactgggcctgccaagggtgcgtcctaacgggcctctgggtcatagcccacgagtgcggccaccacgccttcagcgactac

SEQ ID NO: 7537 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcctctctacggggcctgccaagggtgcgtcctaacgggcctctgggtcatcgcccacgaatgcggccaccacgccttcagcgactac

SEQ ID NO: 7538 - DNA, 441 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggtggccatcgccagccacgatggtggcaagcaggcgctggagacggtccagcggctgttgccggtgctgtgccaggcccacggcttgacccctggcctctctactgggcctgccaagggtgcgtcctaaccggcgtctgggtcatagcccacgagtgcggccaccacgccttcagcgactac

SEQ ID NO: 7539 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccaagggtgcgtcctaaccggcgtctgggtcatagcccacgagtgcggccaccacgccttcagcgactac

SEQ ID NO: 7540 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagatctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 7541 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 7542 - DNA, 349 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7543 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaagggtgcgtcctagccggcgtctgggtcatagcccacgagtgcggccaccacgccttcagcgactac

SEQ ID NO: 7544 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggtcatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7545 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacacaatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttcttctacgtcgccaccacttacttccctctcctccctcaccctctctcctactgtcctctctactgggcctgccaagggtgcgtcctcaccggtgtctgggtcatagcccacgagtgcggccaccacgccttcagcgactac

SEQ ID NO: 7546 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctaccaagggtgcgtcctaaccggcgtctgggtcatagcccacgagtgcggccaccacgccttcagcgactac

SEQ ID NO: 7547 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagcactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccaagggtgcgtcctaaccggcgtctgggtcatagcccacgagtgcggccaccacgccttcagcgactac

SEQ ID NO: 7548 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtcttggtcatagcccacgagtgcggccaccacgccttcagcgactac

SEQ ID NO: 7549 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctagccggcgtcggggtcatagcccacgagtgcggccaccacgccttcagcgactac

SEQ ID NO: 7550 - DNA, 348 bp, Artificial
  Mutation in BnaC.FAD2.a introduced by TALE nuclease pair BnFAD2_T01
caggatccatgggtgcaggtggaagaatgcaagtgtctcctccctacaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 7551 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctccatcccacgctccttctcctcttcgacatcatcatctcctcctcggctcctccatctaccacctctccacagcctacttccctctcctccctcaccctctctcctactttggcctctctactgggcctgccaagggtgcgtcctaaccggcgtctgggtcatagcccacgagtgcggccaccacgccttcagcgactac

SEQ ID NO: 7552 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccaagggtgcgtcctaacgggcctctgggtcatagcccacgagtgcggccaccacgccttcagcgactac

SEQ ID NO: 7553 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaacgggcctctgggtcatagcccacgagtgcggccaccacgccttcagcgactac

SEQ ID NO: 7554 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctctggcccctctactgggcctgccaaggctgcgtcctaacgggcctctgggtcatcgcccacgaatgcggccaccacgccttcagcgactac

SEQ ID NO: 7555 - DNA, 348 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 7556 - DNA, 462 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttccgcgttgaccaacgaccacctcgtcgccttggcctgcctcggcgggcgtcctgcgctggatgcagtgaaaaagggattgggggatcctatcagccgttcccagctggacgcctggcctctctactgggcctgccaaggctgcgtcctaacgggcctctgggtcatcgcccacgaatgcggccaccacgccttcagcgactac

SEQ ID NO: 7557 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactatcggagaactcaagaaagcaatcccaccgcactgtttcaaacgctcgatccctcgctctttctcctacctcatctgggacatcatcatagcctcctgcttctactacgtcgccaccacttacttccctctcctccccccccctcccccttacccctctactgggcctgccaaggctgcgtcctaacgggcctctgggtcatagcccacgagtgcggccaccacgccttcagcgactac

SEQ ID NO: 7558 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtcttggtcatagcccacgagtgcggcctccacgccttcagcgactac

SEQ ID NO: 7559 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtcggggtcatagcccacgagtgcggccaccacgccttcagcgactac

SEQ ID NO: 7560 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 7561 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaaggctgcgtcctaacgggcctctgggtcatagcccacgagtgcggccaccacgccttcagcgactac

SEQ ID NO: 7562 - DNA, 343 bp, Artificial
  Mutation in BnaC.FAD2.a introduced by TALE nuclease pair BnFAD2_T01
caggatccatgggtgcaggtggaagaatgcaagtgcctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacctctctactgggcctgccaagggtgcgtcctaaccggcgtctgggtcatagcccacgagtgcggccaccacgccttcagcgactac

SEQ ID NO: 7563 - DNA, 349 bp, Artificial
  Mutation in BnaC.FAD2.a introduced by TALE nuclease pair BnFAD2_T01
caggatccatgggtgcagggggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaatggtgcgtcctaacgggcctctgggtcatcgcccacgaatgcggccactacgccatcatcgactac

SEQ ID NO: 7564 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcaacatagcctcctgcttctactacgtcgccaccacttacttccctctcctccctcaccctctctctactgggcctgccaagggtgcgtcctaaccggcgtctgggtcatagcccgcgagtgcggccaccacgccttcagcgactac

SEQ ID NO: 7565 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaacgggcctctgggtcatagcccacgagtgcggccaccacgccttcagcgactac

SEQ ID NO: 7566 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctgccaagggtgcgtcctaacgggcctctgggtcatcgcccacgaatgcggccaccacgccttcagcgactac

SEQ ID NO: 7567 - DNA, 409 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcgcctggcaaataatgattttattttgactgatagtgacctgttcgttgcaacaaatggatgagctctctactgggcctgccaagggtgcgtcctaaccggcgtctgggtcatagcccacgagtgcggccaccacgccttcagcgactac

SEQ ID NO: 7568 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattggcctctctactgggcctgccaagggtgcgtcctaaccggcgtctgggtcatagcccacgagtgcggccaccacgccttcagcgactac

SEQ ID NO: 7569 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttggcctctctactgggcctgccaagggtgcgtcctaaccggcgtctgggtcatagcccacgagtgcggccaccacgccttcagcgactac

SEQ ID NO: 7570 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcactcccaccgcactgtttcaaacgctcgatccctcgctctttctcctacctcatctgggacatcatcatagcctcctgcttctactacggcgccaccacttacttccctctcctccctcaccctctctcctacctctctactgggcctgccaaggctgcgtcctaacgggcctctgggtcatcgcccacgaatgcggccaccacgccgtcagcgactac

SEQ ID NO: 7571 - DNA, 377 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgggcgtcctgcccgccaccctccgggccgttgcttcacaccatcgtggctggcgatggccaccgcctgctccggggtcatggcccacgagtgcggccaccacgccttcagcgactac

SEQ ID NO: 7572 - DNA, 338 bp, Artificial
  Mutation in BnaC.FAD2.a introduced by TALE nuclease pair BnFAD2_T01
caggatccatgggtgcaggtggaagaatgcaagtgtctcatccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctaatacgtcgccaccacttacttccctctcctccctcaccctctctctctctactgggcctgccaagggtgcgtcctaaccggcgtctgggtcatagcccacgagtgcggccaccacgccttcagcgactac

SEQ ID NO: 7573 - DNA, 323 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagggtgcgtcctaaccggcgtcggggtcatagcccacgagtgcggccaccacgccttcagcgactac

SEQ ID NO: 7574 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattaactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgatggcctctctactgggcctgccaagggtgcgtcctaaccggcgtctgggtcatagcccacgagtgcggccaccacgccttcagcgactac

SEQ ID NO: 7575 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatatcccacgagtgcggccaccacgccttcagcgactac

SEQ ID NO: 7576 - DNA, 300 bp, Artificial
  Mutation in BnaC.FAD2.a introduced by TALE nuclease pair BnFAD2_T01
caggatccatgggtgcaggtggaagaatgcaagtgtctcgtccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcgtctgggacatcatcatagcctcctgcttctactacgtctctctactgggcctgccaagagtgcgtcctaaccggcgtctgggtcatagcccgcgagtgcggccaccacgccctgaacaactac

SEQ ID NO: 7577 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctatctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 7578 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcccctctactgggcctgccaaggctgcgtcctaacgggcgtctgggtcatagcccacgagtgcggccaccacgccttcagcgactac

SEQ ID NO: 7579 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacttcgccaccacttacttccctctcctccctcaccctctctcctggcctctctactgggcctgccaatggtgcgtcctaaccggcgtctgggtcatagcccacgagtgcggccaccacgccttcagcgactac

SEQ ID NO: 7580 - DNA, 404 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcggatttgtcctactcaggagagcgttcaccgacaaacaacagataaaacgaaaggcccgcctggcctctctactgggccggccaagggtgcgtcctaaccggcgtctgggtcatagcccacgagtgcggccaccacgccttcagcgactac

SEQ ID NO: 7581 - DNA, 380 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacagtggtccggcgcacgcgctctggaggcctgcctctctactgggcctgccaagggtgcgtcctaaccggcgtctgggtcatagcccacgagtgcggccaccacgccttcagcgactac

SEQ ID NO: 7582 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatcccccgctctttctcctacctcatctgggacatcatcatagcctcctgcttctactacgtcgccaccacttacttccctctcctccctcaccctctctcttacttctggcctctctactgggcctgccaagggtgcgtcctaaccggcgtctgggtcatagcccacgagtgcggccaccacgccttcagcgactac

SEQ ID NO: 7583 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgccttcagcgactac

SEQ ID NO: 7584 - DNA, 424 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctccagcgcctgcttgccgccatcgtggctggcgatggccaccacctgctccggggtcaagccgtgggcctggcatggcctctctactgggcctgccaagggtgcgtcctaaccggcgtctgggtcatagcccacgagtgcggccaccacgccttcagcgactac

SEQ ID NO: 7585 - DNA, 404 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcttgccgccagcgtggctggcgatggcgaccccctgctgcggggtcaagccgggggcctctctacagagcctgccaagggtgcgtcctaaccggcgtctgggtcatagcccacgagtgcggccaccacgccttcagcgagtac

SEQ ID NO: 7586 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctgcctctctactgggcctgccaagggtgcgtcctaaccggcgtctgggtcatagcccacgagtgcggccaccacgccgtcagcgactac

SEQ ID NO: 7587 - DNA, 346 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgagtgcggccaccacgccttcagcgactac

SEQ ID NO: 7588 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatcgcccacgaatgcggccaccacgccttcagcgactac

SEQ ID NO: 7589 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttagcctgccaagggtgcgtcctaaccggcgtctgggtcatagcccacgagtgcggccaccacgccttcagcgactac

SEQ ID NO: 7590 - DNA, 312 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccgcgagtgcggccacaacgccttcagcgactac

SEQ ID NO: 7591 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctagcctctctactggacctgccaagggtgcgtcctaaccggcgtctgggtcatagcccacgagtgcggccaccacgccttcagcgactac

SEQ ID NO: 7592 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgatacaccacccttcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagttcggccaccactccttcagcgactac

SEQ ID NO: 7593 - DNA, 344 bp, Artificial
  Mutation in BnaC.FAD2.a introduced by TALE nuclease pair BnFAD2_T01
caggatacatgggtgcaggtggaagaatgcaagtgtctcctccctccaagaagtctgaaaccgacaccatcaagcgcgtaccccgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactggacctgccaagggtgcgtcctaaccggcgtcggggtcatagcccacgagtgcggccaccacgccttcagcgactac

SEQ ID NO: 7594 - DNA, 389 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtaggagaactcaagaaagcaatcccaccgcactgtttcaaacgctcgatccctcgctctttctcctacctcatctgggacatcatcatagcctcctgcttctactacgtcgccaccacttacttccctctcctccctcaccacccacgtataaaccgtcgatgccctgctgaatattgaactgaaccaggcgactggcctctctactgggcctgccaagggtgcgtcctaaccggcgtctgggtcatagcccacgagtgcggccaccacgccttcagcgactac

SEQ ID NO: 7595 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggggcctggcctctctactgggcctgccatgggtgcgtcctaaccggcgtctgggtcatagcccacgagtgcggccaccacgccttcagcgactac

SEQ ID NO: 7596 - DNA, 383 bp, Artificial
  Mutation in BnaC.FAD2.a introduced by TALE nuclease pair BnFAD2_T01
caggatccatgggcgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcagcggctgttgccggtgctgtgccaggcccacggcttctctctactgggcctgccaagggtgcgtcctaaccggcgtctgggtcatagcccacgagtgcggccaccacgccttcagcgactac

SEQ ID NO: 7597 - DNA, 374 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccaggcttatcttggacaagaagaagatcgctctctactgggcctgccaagggtgcgtcctaaccggcgtctgggtcatagcccacgagtgcggccaccacgccttcagcgactac

SEQ ID NO: 7598 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaacgggcctctgggtcatagcccacgagtgcggccaccacgccttcagcgactac

SEQ ID NO: 7599 - DNA, 351 bp, Artificial
  Mutation in BnaC.FAD2.a introduced by TALE nuclease pair BnFAD2_T01
caggatccatgggtgcaggtggaagaatgcaagtgactcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaaccggcgtctgggtcatagcccacgagtgcggccaccacgccatcagcgactac

SEQ ID NO: 7600 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgtctctctactgggcctgccaagggtgcgtcctaaccggcgtcggggtcatagcccacgagtgcggccaccacgccttcagcgactac

SEQ ID NO: 7601 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaacgggcctctgggtcatagcccacgagtgcggccaccacgccttcagcgactac

SEQ ID NO: 7602 - DNA, 334 bp, Artificial
  Mutation in BnaC.FAD2.a introduced by TALE nuclease pair BnFAD2_T01
caggatccattggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccacgagtgcggccaccacgccttcagcgactac

SEQ ID NO: 7603 - DNA, 341 bp, Artificial
  Mutation in BnaC.FAD2.a introduced by TALE nuclease pair BnFAD2_T01
caggatcatgggggcaggtggaagaatgcaagtgtctcctccctccaagaagtctgaaaccgacacaatcaagcgcgtaccctgcgagacaccgcccttcactgtcggagaactcaagaaagcaatcccaccgcactgtttcaaacgctcgatccctcgctctttctcctacctcatctgggacataatcatagcctcctgcttctactacgtcgccaccacttacttccctctcctccctcaccctcgcctcgcctctctactgggcctgcccagcgtgcgtcctaaccggcgtctgggtcataccccaccagtgcggccaccacgccttcagccactac

SEQ ID NO: 7604 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaacgggcctctgggtcatagcccacgagtgcggccaccacgccttcagcgactac

SEQ ID NO: 7605 - DNA, 348 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 7606 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 7607 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcctctgggtcatcgcccacgaatgcggccaccacgccttcagcgactac

SEQ ID NO: 7608 - DNA, 345 bp, Artificial
  Mutation in BnaC.FAD2.a introduced by TALE nuclease pair BnFAD2_T01
caggatccatgggtgcaggtggaagaatgcaagtctctcctcactccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 7609 - DNA, 349 bp, Artificial
  Mutation in BnaC.FAD2.a introduced by TALE nuclease pair BnFAD2_T01
catgatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgttggcctctctactgggcctaccaagggtgcgtcctaaccggcgtcttggtcatagcccacgagtgcggccaccacgccttcagcgactac

SEQ ID NO: 7610 - DNA, 380 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacagtgggccggcgcacgcgctctggaggcctgcctctctactgggccggccaagggtgcgtcctaaccggcgtctgggtcatagcccacgagtgcggccaccacgccttcagcgactac

SEQ ID NO: 7611 - DNA, 312 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactcc

SEQ ID NO: 7612 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcgctcctactgctggcctctctactgggcctgccaagggtgcgtcctaaccggcgtctgggtcatagcccaccagtgcggccaccacgccttcagcgactac

SEQ ID NO: 7613 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctccttcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7614 - DNA, 344 bp, Artificial
  Mutation in BnaC.FAD2.a introduced by TALE nuclease pair BnFAD2_T01
caggatccattgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctgcctctctactgggcctgccaaggctgcgtcctaacgggcctctgggtcatcgcccacgaatgcggccaccacgccttcagcgactac

SEQ ID NO: 7615 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggcctgccaagggtgcgtcctaaccggcgtctgggtcatagcccacgagtgcggccaccacgccttcagcgactac

SEQ ID NO: 7616 - DNA, 324 bp, Artificial
  Mutation in BnaC.FAD2.a introduced by TALE nuclease pair BnFAD2_T01
caggatccatgggtgcaggtggaagaatgcaagtgtcacctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcgccaagggtgcgtcctaaccggcgtcggggtcatagcccgcgagtgcggccaccacgccatgagcaactac

SEQ ID NO: 7617 - DNA, 351 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcctggcctctctactgtgcctgccaagggtgcgtcctagccggcgtctgggtcatagcccacgagtgcggccaccacgccttcagcgactac

SEQ ID NO: 7618 - DNA, 351 bp, Artificial
  Mutation in BnaC.FAD2.a introduced by TALE nuclease pair BnFAD2_T01
caggatccatgggtgcaggtggaagaatgcaagtgtatcctccctcccagaagcctgaaaccgacaccatccagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactacgtggcctctctactgggcctgccaagggtgcttcctagccggcttcggggtcaaagcccaccagtgccgcctccacgccttcagccactac

SEQ ID NO: 7619 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctacttggcctctctactgggcctgccaagggtgcgtcctaacgggcctctgggtcatagcccacgagtgcggccaccacgccttcagcgactac

SEQ ID NO: 7620 - DNA, 321 bp, Artificial
  Mutation in BnaC.FAD2.a introduced by TALE nuclease pair BnFAD2_T01
caggatccatgggtgcaggtggaagaatgcaagtgtctcctccctcccagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaaccggcgtctgggtcatagcccacgagtgctgccaccacgccttcatcgactac

SEQ ID NO: 7621 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactgcctctctactgggcctgccaagggtgcgtcctagccggcgtctgggtcatagcccacgagtgcggccaccacgccttcagcgactac

SEQ ID NO: 7622 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacctctctactgggcctgccaagggtgcgtcctaaccggcctctgggtcatagcccacgagtgcggccaccacgccttcagcgactac

SEQ ID NO: 7623 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgccgccaccacttacttccctctcctccctccccctctctcccacgtcctctctactgggcctgccaagggtgcgtcctaaccggcgtctgggtcatagcccacgagtgcggccaccacgccttcagcgactac

SEQ ID NO: 7624 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaactctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 7625 - DNA, 347 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcgtcatagcctcctgcttctactacgtcgccaccacttacttccctctcctccctcaccctctctcctattggcctctctactgggcctgccaagggtgcgtcctaaccggcgtctgggtcatatcccacgagtgcggccaccacgccttcagcgactac

SEQ ID NO: 7626 - DNA, 358 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcgcctaacctggcctctctactgggcctgccaagggtgcgtcctaaccggcgtctggggcatagcccacgagtgcggccaccacgccttcagcgactac

SEQ ID NO: 7627 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 7628 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgtcctaaccggcgtctgggtcatagcccacgagtgcggccaccacgccatcagcgactac

SEQ ID NO: 7629 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccactggcctctctactgggcctgccaagggtgcgtcctaaccggcgtctgggtcatagcccacgagtgcggccaccacgccttcagcgactac

SEQ ID NO: 7630 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacacaatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgtgcctgccaagggtgcgtcctatccggcgtctgggtcatagcccacgagtgcggccaccacgccttccgcgactac

SEQ ID NO: 7631 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccctctctactgggcctgccaagggtgcgtcctaaccggcgtctgggtcatagcccacgagtgcggccaccacgccttcagcgactac

SEQ ID NO: 7632 - DNA, 351 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccaagggtgcgtcctaaccggcgtctgggtcatagcccacgagtgcggccaccacgccttcagcgactac

SEQ ID NO: 7633 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccgaactctctactgggcctgccaaggctgcgtcctaacgggcgtctgggtcatagcccacgagtgcggccaccacgccttcagcgactac

SEQ ID NO: 7634 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctcctctctactgggcctgccaagggtgcgtcctaaccggcgtctgggtcatagcccacgagtgcggccaccacgccttcagcgactac

SEQ ID NO: 7635 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcatcctgcttctactacgtcgccaccacttacttccctctccgccctcaccctctctcccactctcctctctactgggcctgccaagagtgcgtcctaaccggcgtctgggtcatagcccacgagtgcggccaccacgccatgaacgactac

SEQ ID NO: 7636 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaacccaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7637 - DNA, 348 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaaggctgcgtcctaacgggcctctgggtcatagcccacgagtgcggccaccacgccttcagcgactac

SEQ ID NO: 7638 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctacgagacaccgcccttcactgtcggagaactcaagaaagcaatcccaccgcactgtttcaaacgctcgatccctcgctctttctcctacctcatctgggacatcatcatagcctcctgcctctactacgtcgccaccacttacttccctctcctccctcaccctctctcctcctctcgcctctctactgggcctgccaagggtgcgtcctaaccggcgtctgggtcatagcccacgagtgcggccaccacgccttcagcgactac

SEQ ID NO: 7639 - DNA, 350 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 7640 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctatgggcctctctacggggcctgccaggggcgcgtccaacccggcgtctggggcatagcccacgagggcggccaccacgcctgcaccgactac

SEQ ID NO: 7641 - DNA, 424 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttctccagcgcctgcttgccgccatcgtggctggcgatggccaccccctgctggggggtcaagccgtgggcctggcatggcctctctactgggcctgccaaggctgcgtcctaacgggcctctgggtcatagcccacgagtgcggccaccacgccttcagcgactac

SEQ ID NO: 7642 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctggtacatcatcatagcctcctgcttctactacgtcgccaccacttacttccctctcctccctcaccctctctcctccctcgtggcctctctactgggcctgccaagggtgcgtcctaaccggcgtctgggtcatagcccacgagtgcggccaccacgccttcagcgactac

SEQ ID NO: 7643 - DNA, 393 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctaacggtgcaggcgctgttgccggtgctgtgccaggcccacggcttgacccctggcctctctactgggcctgccaagggtgcgtcctaaccggcgtctgggtcatagcccacgagtgcggccaccacgccttcagcgactac

SEQ ID NO: 7644 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccgcctggcctctctactgggcctgccaagggtgcgtcctaaccggcgtctgggtcatagcccacgagtgcggccaccacgccttcagcgactac

SEQ ID NO: 7645 - DNA, 378 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctccagcgcctgcttgccgccatcgtggctggcgatggccaccacctgctccggggtcaagccgtgagggctgggtcatagcccacgagtgcggccaccacgccttcagcgactac

SEQ ID NO: 7646 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 7647 - DNA, 343 bp, Artificial
  Mutation in BnaC.FAD2.a introduced by TALE nuclease pair BnFAD2_T01
caggatccatgggtgcagggggcagaatgcaagtgtctactccctccaagaagtctgaaaccgacaccatcaagcgcgtaccctgcgagacaccgaccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgcgccggccaagggtgcgtcctaaccggcgtctgggacatagcccacgagtgcggccaccgcgccttcagcgactac

SEQ ID NO: 7648 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccgcttacttccctctcctccctcaccctctcccctactcctctctactgggcctgccaagggtgcgtcctaaccggcgtctgggtcatagcccacgagtgcggccaccacgccttcagcgactac

SEQ ID NO: 7649 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctactgcgccctctctactgggcctgccaagggtgcgtcctaaccggcgtctgggtcatagcccacgagtgcggccaccacgccttcagcgactac

SEQ ID NO: 7650 - DNA, 405 bp, Artificial
  Mutation in BnaC.FAD2.a introduced by TALE nuclease pair BnFAD2_T01
caggatccatgggtgcaggtggaagaatgcaagtctctcctccctccagctcccccggaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcaatgcactgacgggtgccccgctcaacttgaccccccagcaggtggtggccatcggcctctctactgggcctgccaaggctgcgtcctaacgggcctctgggtcatagcccacgagtgcggccaccacgccttcagcgactac

SEQ ID NO: 7651 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcatctgggacatcatcatagcctcctgcttctactacgtcgccaccacttacttccctctcctccctcaccctctctctctctactgggcctgccaagggtgcgtcctaaccggcgtctgggtcatagcccacgagtgcggccaccacgccttcagcgactac

SEQ ID NO: 7652 - DNA, 354 bp, Artificial
  Mutation in BnaC.FAD2.a introduced by TALE nuclease pair BnFAD2_T01
caggatccatgggtgcaggtggaagaatgcaagtctctcatccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccgcctggcctctctactgggcctgccaagggtgcgtcctaaccggcgtctgggtcatagcccacgagtgcggccaccacgccttcagcgactac

SEQ ID NO: 7653 - DNA, 347 bp, Artificial
  Mutation in BnaC.FAD2.a introduced by TALE nuclease pair BnFAD2_T01
caggatccatgggtgcaggtggcagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactctcctctctactgggcctgccaagggtgcgtcctaaccggcgtctgggtcatagcccacgagtgcggccaccacgccttcagcgactac

SEQ ID NO: 7654 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcttagcctcctgcttctactacgtcgccaccacttacttccctctcctccctcaccctctctcctggcctctctactgggcctgccaagggtgcgtcctaaccggcgtctgggtcatagcccacgagtgcggccaccacgccttcagcgactac

SEQ ID NO: 7655 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccaaggctgcgtcctaacgggcctctgggtcatcgcccacgaatgcggccaccacgccttcagcgactac

SEQ ID NO: 7656 - DNA, 349 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgcttcaaacgctcgatccctcgctctttctcctacctcatctgggacgtcatcatagcctcctgctcctactacgtcgccaccacttacttccctctcctccctcaccccctctcctaccctggcctctctactgggcctgccaagggtgcgtcctaaccggcgtctgggtcatagcccacgagtgcggccaccacgccttcagcgactac

SEQ ID NO: 7657 - DNA, 408 bp, Artificial
  Mutation in BnaC.FAD2.a introduced by TALE nuclease pair BnFAD2_T01
caggatccatgggtgcaggtggcagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgagccgaagtttccaaaaggtcgttgatcaaagctcgccgcgttgtttcatcaagccttggcctctctactgggcctgccaagggtgcgtcctaaccggcgtcggggtcatagcccacgagtgcgtcctccacgccttcatcgactac

SEQ ID NO: 7658 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 7659 - DNA, 350 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccatcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcttggcctctctactgggcctgccaagggtgcgtcctaaccggcgtctgggtcatagcccacgagtgcggccaccacgccttcagcgactac

SEQ ID NO: 7660 - DNA, 342 bp, Artificial
  Mutation in BnaC.FAD2.a introduced by TALE nuclease pair BnFAD2_T01
caggatccatgggtgcaggtggaagaatgcaagtgtctactccctcaaagaagtctgaaaccgacaccatcaagcgcgtaccctgcgagacaccgcccttcactgtcggagaactcaagaaagcaatccaccgcactgtttcaaacgctcgatccctcgctctttctcctacctcatctgggacatcatcatagcctcctgcttctactacgtcgccaccacttacttccctctcctccctcaccctctcccttacccctctactgggcctgccaaggctgcgtcctaacgggcctctgggtcatcgcccacgaatgctgccaccacgccttcagcgactac

SEQ ID NO: 7661 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttccactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 7662 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtccgaaccggcgtctgggtcatagcccacgagtgcggccaccacgcctgcagcgactac

SEQ ID NO: 7663 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaaggctgcgtcctaacgggcctctgggtcatagcccacgagtgcggccaccacgccttcagcgactac

SEQ ID NO: 7664 - DNA, 350 bp, Artificial
  Mutation in BnaC.FAD2.a introduced by TALE nuclease pair BnFAD2_T01
caggatccatgtgtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttggcctctctactgggcctgccaagggtgcgtcctaaccggcgtctgggtcatagcccacgagtgcggccaccacgccttcagcgactac

SEQ ID NO: 7665 - DNA, 357 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatgatcatagcctcctgcttctactacgtcgccaccacttacttccctctcctccctcaccggtttgcgtattgccggtgcctggcctctctactgggcctgccaagggtgcgtcctaaccggcgtctgggtcatagcccacgagtgcggccaccacgccttcagcgactac

SEQ ID NO: 7666 - DNA, 343 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 7667 - DNA, 349 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 7668 - DNA, 332 bp, Artificial
  Mutation in BnaC.FAD2.a introduced by TALE nuclease pair BnFAD2_T01
caggatccatgggtgcaggtggaagaatgcaagtgtatactccctccaagaagtctgaaacctacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 7669 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaacgggcctctgggtcatagcccacgagtgcggccaccacgccttcagcgactac

SEQ ID NO: 7670 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagggcggccaccacgccttcagcgactac

SEQ ID NO: 7671 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgcctctctactgggcctgccaagggtgcgtcctaacgggcctctgggtcatcgcccacgaatgcggccaccacgccttcagcgactac

SEQ ID NO: 7672 - DNA, 343 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctgcctctctactgggccggccaagggtgcggcctaaccggcgtctgggtcatagcccacgagtgcggccaccacgccatcagcgactac

SEQ ID NO: 7673 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaaccggcgtcggggtcatagcccacgagtgcggccaccacgccttcagcgactac

SEQ ID NO: 7674 - DNA, 347 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaaggctgcgtcctaacgggcctctgggtcatagcccacgagtgcggccaccacgccttcagcgactac

SEQ ID NO: 7675 - DNA, 387 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttcgccgccatcgtggctggcgatggccaccacctgctcctggcctctctactgggcctgccaagggtgcgtcctaacgggcctctgggtcatagcccacgagtgcggccaccacgccttcagcgactac

SEQ ID NO: 7676 - DNA, 338 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcctgccaagggtgcgtcctaaccggcgtctgggtcatagcccacgagtgcggccaccacgccttcagcgactac

SEQ ID NO: 7677 - DNA, 345 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgccttcagcgactac

SEQ ID NO: 7678 - DNA, 356 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 7679 - DNA, 343 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctgcctctctactgggcctgccaagggtgcgtcctaaccggcgtctgggtcatagcccacgagtgcggccaccacgccttcagcgactac

SEQ ID NO: 7680 - DNA, 408 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgagccgaagtttccaaaaggtcgttgatcaaagctcgccgcgttgtttcatcaagccttggcctctctactgggcctgccaagggtgcgtcctaaccggcgtctgggtcatagcccacgagtgcggccaccacgccttcagcgactac

SEQ ID NO: 7681 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccctggcctctctactgggcctgccaagggtgcgtcctaaccggcgtctgggtcatagcccacgagtgcggccaccacgccttcagcgactac

SEQ ID NO: 7682 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 7683 - DNA, 350 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctctccctctctcctacttctggcctctctactgggcctgccaagggtgcgtcctgaccggcgtctgggtcatagcccacgagtgcggccaccacgcctgcagcgactac

SEQ ID NO: 7684 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaagggtgcgtcctaaccggcgtctgggtcatagcccacgagtgcggccaccacgcctgcagcgactac

SEQ ID NO: 7685 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgtgtcatagcccacgagtgcggccaccacgccttcagcgactac

SEQ ID NO: 7686 - DNA, 349 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccaagggtgcgtcctaaccggcgtctgggtcatagcccacgagtgcggccaccacgccatcagcgactac

SEQ ID NO: 7687 - DNA, 343 bp, Artificial
  Mutation in BnaC.FAD2.a introduced by TALE nuclease pair BnFAD2_T01
caggatccatgggtgcaggtggaagaatgcaagtgtatactcactcccaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagcgcggcctcctcgcctgcatccactac

SEQ ID NO: 7688 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 7689 - DNA, 347 bp, Artificial
  Mutation in BnaC.FAD2.a introduced by TALE nuclease pair BnFAD2_T01
caggatccatgggtgcaggtgaaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaaggctgcgtcctaacgggcctctgggtcatcgcccacgaatgcggccaccacgccttcagcgactac

SEQ ID NO: 7690 - DNA, 352 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcaagacaccacccttcactctcggagacctcaagaaagcaatcccaccgcactgtttcaaacgctcgatccctcgctctttctcctacctcatccgggacatcatcatagcctcctgcttctactacgtcgccaccacttacttccctctcctccctcaccctctctcctacttcgctggcctctctactgggcctgccaagggtgcgtcctaaccggcgtctgggtcatagcccacgagtgcggccaccacgccttcagcgactac

SEQ ID NO: 7691 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccaagggtgcgtcctaacgggcctctgggtcatcgcccacgaatgcggccaccacgccttcagcgactac

SEQ ID NO: 7692 - DNA, 318 bp, Artificial
  Mutation in BnaC.FAD2.a introduced by TALE nuclease pair BnFAD2_T01
caggatccatgggtgcaggtggaagaatgcaagtgtctcctccctcccagacgtctgaaaccgacaccatcaagcgcgtaccctgcgagacaccgcccttcactgtcggagaactcaagaaagcaatcccaccgcactgtttcaaacgctcgatccctcgctctttctcatacctcatctgggacatcctcatagcctcctgcttctactacgtcgccaccacttggcaggcctctctactgggcctgccaagggtgcgtcctaaccggcgtctgggtcatagcccacgagtgcggccaccacgccttcagcgactac

SEQ ID NO: 7693 - DNA, 345 bp, Artificial
  Mutation in BnaC.FAD2.a introduced by TALE nuclease pair BnFAD2_T01
caggatccatgggtgcaggtggaagaatgcaagtgtatcctccctccaaaaagtctgaaaccgacaccatccagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccctggcctctctactgggcctgccaagggtgcgtcctaaccggggtctgggtcatagcccacgagtgcttccaccacgccttcagcgactac

SEQ ID NO: 7694 - DNA, 356 bp, Artificial
  Mutation in BnaC.FAD2.a introduced by TALE nuclease pair BnFAD2_T01
caggatccatgggtgcaggtggaagaatgcaagtgtctcctccctcccagaagtctgaaaccgacaccatcaagcgcgtaccctgcgagacaccgcccttcactgtcggagaactcaagaaagcaatcccaccgcactgtttcgaacgctcgatccctcgctctttctcctacctcatctgggacatcatcatagcctcctgcttctactacgtcgccaccacttacttccctctcctccctcaccctctctcctacttcgccgcctagcctctctactgggcctgccaagggtgcgtcctaaccggcgtctgggtcatagcccacgagtgcggccaccgcgccttcagcgactac

SEQ ID NO: 7695 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctctttctcctacctcatctgggacatcatcatagcctcctgcttctactacgtcgccaccacttacttccctctcctccctcaccctctctcctacttggcctctctactgggcctgccaagggtgcgtcctaacgggcctctgggtcatcgcccacgaatgcggccaccacgccttcagcgactac

SEQ ID NO: 7696 - DNA, 342 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtcccctgcgagacaccgcccttcactgtcggagaactcaagaaagcaatcccaccgcactgtttcaaacgctccatccctcgctctttctcctacctcatctgggacatcatcatagcctcctgcttctactacgtcgccaccacttacttccctctcctccctcaccctctccctgtctctctactgggcctgccaagggtgcgtcctaaccggcgtctgggtcatagcccacgagtgcggccaccacgccttcagcgactac

SEQ ID NO: 7697 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggcgcgtcctaaccggcgtctgggtcatagcccacgagtgcggccaccacgccttcagcgactac

SEQ ID NO: 7698 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccaagggtgcgtcctaaccggcgtctgggtcatagcccacgagtgcggccaccacgccttcagcgactac

SEQ ID NO: 7699 - DNA, 352 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccaagggtgcgtcctaaccggcgtctgggtcatagcccacgagtgcggccaccacgccttcagcgactac

SEQ ID NO: 7700 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacctccctctcctccctcaccctctcccttacctggcccctctactgggcctgccaaggctgcgtcctaacgggcctctgggtcatcgcccacgaatgcggccaccacgccttcagcgactac

SEQ ID NO: 7701 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaaccggcgtctgggtcatagcccacgagtgcggccaccacgccttcagcgactac

SEQ ID NO: 7702 - DNA, 357 bp, Artificial
  Mutation in BnaC.FAD2.a introduced by TALE nuclease pair BnFAD2_T01
ccggatccatgggtgcaggtggaagaatgcaagtgtctcctccctccaagaagtctgcaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggtgcctggcctctctactgggcctgccaagggtgcgtcctaaccggcgactgggtcatagcccacgagtgcggccaccacgccatcagcgactac

SEQ ID NO: 7703 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggtgcctggcctctctactgggccggccaagggtgcgtcctaaccggcgtctgggtcatagcccacgagtgcggccaccacgccttcagcgactac

SEQ ID NO: 7704 - DNA, 325 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacatcatctgggacatcatcatagcctcctgcttctactacgtcgccaccacttacttccctctcctccctcaccctctctcctacttggctgcgtcctaaccggcgtctgggtcatagcccacgagtgcggccaccacgccttcagcgactac

SEQ ID NO: 7705 - DNA, 338 bp, Artificial
  Mutation in BnaC.FAD2.a introduced by TALE nuclease pair BnFAD2_T01
caggatccatgggtgcaggtgaaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaagggtgcgtcctaaccggcgactgggtcatagcccacgagtgcggccaccacgccttcagcgactac

SEQ ID NO: 7706 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 7707 - DNA, 345 bp, Artificial
  Mutation in BnaC.FAD2.a introduced by TALE nuclease pair BnFAD2_T01
caggatccaatgggggcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggccatcatcatagcctcctgcttctactacgtcgccaccacttacttccctctcctccctccccctctctcctagcctcactactgggcctgccaagggtgcgtcctaaccggcgtctgggtcatagcccacgagtgcggccaccacgccttcagcgactac

SEQ ID NO: 7708 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctggcctctctactgggcctgccaagggtgcgtcctaaccggcgtctgggtcatagcccacgagtgcggccaccacgccttcagcgactac

SEQ ID NO: 7709 - DNA, 349 bp, Artificial
  Mutation in BnaC.FAD2.a introduced by TALE nuclease pair BnFAD2_T01
caggatccatgggtgcaggtggcagaatgcaagtgtctcccccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcacctgggacatcatcatagcctcctgcttctactacgtcgccaccacttacttccctctcctccctcaccctctctcctacgttggcctctctactgggcctgccaagggtgcgtcctaaccggcgtcggggtcatagcccacgagtgcggccaccacgccttcagcgactac

SEQ ID NO: 7710 - DNA, 332 bp, Artificial
  Mutation in BnaC.FAD2.a introduced by TALE nuclease pair BnFAD2_T01
caggatccatgggtgcaggtggaagaatgcaagtgtctactccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccatgggtgcgtcctaaccggcgtctgggtcatagcccacgagtgcggccaccgcgccttcagcgactac

SEQ ID NO: 7711 - DNA, 374 bp, Artificial
  Mutation in BnaC.FAD2.a introduced by TALE nuclease pair BnFAD2_T01
caggatccatgggtgcaggtggcagaatgcaagtgtctcctccctccaagaagtcttaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccaggcttatcttggacaagaagaagatcgctctctactgggcctgccaagggtgcgtcctaaccggcgtctgggtcatagcccacgagtgcggccaccacgccttcagcgactac

SEQ ID NO: 7712 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctaccccatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 7713 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccactcctctctactgggcctgccaagggtgcgtcctaaccggcgtctgggtcatagcccacgagtgcggccaccacgccttcagcgactac

SEQ ID NO: 7714 - DNA, 357 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccgcccgcctggcctctctactgggcctgccaagggtgcgtcctaaccggcgtctgggtcatagcccacgagtgcggccaccacgccttcagcgactac

SEQ ID NO: 7715 - DNA, 349 bp, Artificial
  Mutation in BnaC.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 7716 - DNA, 351 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactgcgtcgccaccacttacttccctctcctccctcaccctctctcctacttcctggcctctctactgggcctgccaagggtgcgtcctaacgggcctctgggtcatagcccacgagtgcggccaccacgccttcagcgactac

SEQ ID NO: 7717 - DNA, 334 bp, Artificial
  Mutation in BnaC.FAD2.a introduced by TALE nuclease pair BnFAD2_T01
caggatccatgggcgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctgccaagggtgcgtcctaaccggcgtctgggtcatagcccacgagtgcggccaccacgccttcagcgactac

SEQ ID NO: 7718 - DNA, 329 bp, Artificial
  Mutation in BnaC.FAD2.a introduced by TALE nuclease pair BnFAD2_T01
caggatccatgggtgcaggtggaagaatgcaagtgtctcatccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcatgcttctactacgtcgccaccacttacttccctctcctccctcaccctctctcctactgccaagggtgcgtcctaaccggcgtctgggtcatagcccacgagtgcggccaccacgccttcagcgactac

SEQ ID NO: 7719 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttaccttggcccctctactgggcctgccaaggctgcgtcctaacgggcctctgggtcatcgcccacgaatgcggccaccacgccttcagcgactac

SEQ ID NO: 7720 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctatctactgggcctgccaagggtgcgtcctaaccggcgtctgggtcatagcccacgagtgcggccaccacgccttcagcgactac

SEQ ID NO: 7721 - DNA, 345 bp, Artificial
  Mutation in BnaC.FAD2.a introduced by TALE nuclease pair BnFAD2_T01
ccggtccatgggtgcaggtggaagaatgcaattgtctcatccctacaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgctcctactacgtcgccaccacttacttccctctcctccctcaccctctctccaataacctctctactgggcctgccaagggtgcgtcctaaccggcgtctggggcatagcccacgagtgcggcctccgcgccagcaacgactac

SEQ ID NO: 7722 - DNA, 419 bp, Artificial
  Mutation in BnaC.FAD2.a introduced by TALE nuclease pair BnFAD2_T01
caggatccatgggtgcaggtcgcagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcaggcgctgttgccggtgctgtgccaggcccacggcttgaccccccagcaggtggtggcaatcgccagatggcctcgctactgggcctgccaaggctgcgtcctaacgggcctctgggtcatagcccacgagtgcggccaccacgccttcagcgactac

SEQ ID NO: 7723 - DNA, 348 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 7724 - DNA, 342 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgtctctctactgggcctgccaagggtgcgtcctaaccggcgtctgggtcatagcccacgagtgcggccaccacgccttcagcgactac

SEQ ID NO: 7725 - DNA, 339 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtcttggtcatagcccacgagtgcggccaccacgccttcagcgactac

SEQ ID NO: 7726 - DNA, 349 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7727 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctgcctctctactgggcctgccaagggtgcgtcctaaccggcgtctgggtcatagcccacgagtgcggccaccacgccttcagcgactac

SEQ ID NO: 7728 - DNA, 347 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctcctctctactgggcctgccaagggtgcgtcctaaccggcgtctgggtcatagcccacgagtgcggccaccacgccttcagcgactac

SEQ ID NO: 7729 - DNA, 343 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactttttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgtgtcatagcccacgagtgcggccaccacgccttcagcgactac

SEQ ID NO: 7730 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgaggcctctctactgggcctgccaagggtgcgtcctaaccggcgtctgggtcatagcccacgagtgcggccaccacgccttcagcgactac

SEQ ID NO: 7731 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtggcctctctactgggcctgccaagggtgcgtcctaaccggcgtctgggtcatagcccacgagtgcggccaccacgccttcagcgactac

SEQ ID NO: 7732 - DNA, 342 bp, Artificial
  Mutation in BnaC.FAD2.a introduced by TALE nuclease pair BnFAD2_T01
caggatccatgggtgcaggtgaagaatgcaagtgtctcatccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtcggggtcatagcccacgagtgcggccagcacgccttcagcgactac

SEQ ID NO: 7733 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccgtcgtctgggtcatagcccacgagttcggccaccacgccttcagcgactac

SEQ ID NO: 7734 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacacaatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 7735 - DNA, 419 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcaggcgctgttgccggtgctgtgccaggcccacggcttgaccccccagcaggtggtggccatcgccagatggcctctctactgggcctgccaagggtgcgtcctaaccggcgtctgggtcatagcccacgagtgcggccaccacgccttcagcgactac

SEQ ID NO: 7736 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccaagggtgcgtcctaaccggcgtctgggtcatagcccacgagtgcggccaccacgccttcagcgactac

SEQ ID NO: 7737 - DNA, 349 bp, Artificial
  Mutation in BnaC.FAD2.a introduced by TALE nuclease pair BnFAD2_T01
caggatccatgtgtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaacgggcctctgggtcatcgcccacgaatgcggccaccacgccttcagcgactac

SEQ ID NO: 7738 - DNA, 348 bp, Artificial
  Mutation in BnaC.FAD2.a introduced by TALE nuclease pair BnFAD2_T01
caggatccatgggtgcaggtggaagaatgcaagtgtctcccccctccaagaagtctgaaaccgacaccatcaagcgcgtaccctgcgagacaccgcccttcactgtcggagaactcaagaaagcaatcccaccgcactgtttcaaacgctcgatccctctctctttctcctacctcatctgggacatcatcatagcctcctgcttctactacgtcgccaccacttacttccctctcctccctcaccctctctcccacctggcctctctactggtcctgccaaggctgcgtcctaaccggcgtctgggtcatagcccacgagtgcgaccaccacgccttcatcgactac

SEQ ID NO: 7739 - DNA, 389 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccacccacgtataaaccgtcgatgccctgctgaatattgaactgaaccaggcgactggcctctctactgggcctgccaagggtgcgtcctaaccggcgtctgggtcatagcccacgagtgcggccaccacgccttcagcgactac

SEQ ID NO: 7740 - DNA, 349 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7741 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactggacctgccaagggtgcgtcctaaccggcgtctgggtcatcgcccacgaatgcggccaccacgccttcagcgactac

SEQ ID NO: 7742 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagcgtgtgtcctaaccggcgtctgggtcatagcccacgagtgcggccaccacgccttcagcgactac

SEQ ID NO: 7743 - DNA, 347 bp, Artificial
  Mutation in BnaC.FAD2.a introduced by TALE nuclease pair BnFAD2_T01
caggatccatgggtgcaggtggaagaatgcaagtctctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggccagccaagggtgcgtcctaaccggcgtcggggtcatagcccacgagtgcggccaccacgccctcagcgactac

SEQ ID NO: 7744 - DNA, 385 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccgtgggcctggcacagcaccggcaacagccgctggaccgtctccagcgcctgcctggcctctctactgggcctgccaagggtgcgtcctaaccggcgtctgggtcatagcccacgagtgcggccaccacgccttcagcgactac

SEQ ID NO: 7745 - DNA, 321 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacatcgcccttcactgtcggagaactcaagaaagcaatcccaccgcactgtttaaaacgctcgatccctcgctctttctcctacctcatctgggacatcatcatagcctcctgcttctactacgtagccaccacttacttccctctcctccctcaccctctctcaagggtgcgtcctaaccggcgtctgggtcatagcccacgagtgcggccaccacgccttcagcgactac

SEQ ID NO: 7746 - DNA, 325 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggctgcgtcctaaccggcgtctgggtcatagcccacgagtgcggccaccacgccttcagcgactac

SEQ ID NO: 7747 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccaacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7748 - DNA, 312 bp, Artificial
  Mutation in BnaC.FAD2.a introduced by TALE nuclease pair BnFAD2_T01
caggatccatgggtgcaggtggaagaatgcaagtgtatactccctccaagaagtctgaaaccgacaccatcaagcgcgtaccctacgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 7749 - DNA, 317 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccaagggtgcgtcctaaccggcgtctgggtcatagcccacgagtgcggccaccacgccttcagcgacta

SEQ ID NO: 7750 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccaagggtgcgtcctaaccggcgtctgggtcatagcccacgagtgtggccaccacgccttcagcgactac

SEQ ID NO: 7751 - DNA, 339 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccaagggtgcgtcctaaccggcgtctgggtcatagcccacgagtgcggccaccacgcctgcagcgactac

SEQ ID NO: 7752 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttggcctctctactgggcccgccaagggtgcgtcctaaccggcgtctgggtcatagcccacgagtgcggccaccacgccttcagcgactac

SEQ ID NO: 7753 - DNA, 344 bp, Artificial
  Mutation in BnaC.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttggcctctctactgggcccgccaagggtgcgtcctaaccggcgtctgggtcatagcccacgagtgcgtccaccacgccttcagcgactac

SEQ ID NO: 7754 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgacgcctggcctctctactgggcctgccaagggtgcgtcctaaccggcgtctgggtcatagcccacgagtgcggccaccacgccttcagcgactac

SEQ ID NO: 7755 - DNA, 332 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccacctcactgcttcaaacgctccatccctcgctccttctcctacctcatctgggacatcatcatagcctcctgcttctactacgtcgccaccacttacttccctctcctccctcagcctctctactgggcctgccaagggtgcgtcctaaccggcggcggggtcatagcccacgagtgcggccaccacgccttcagcgactac

SEQ ID NO: 7756 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccccggcctctctactgggcctgccaagggtgcgtcctaaccggcgtctgggtcatagcccacgagtgcggccaccacgccttcagcgactac

SEQ ID NO: 7757 - DNA, 358 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttccctcgcctcgtctggcccctctactgggcctgccaaggctgcgtcctaacgggcctctgggtcatcgcccacgaatgcggccaccacgccttcagcgactac

SEQ ID NO: 7758 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 7759 - DNA, 350 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccatcagcgactac

SEQ ID NO: 7760 - DNA, 348 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 7761 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgatacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccaagggtgcgtcctaaccggcgtctgggtcatagcccacgagtgcggccaccacgccttcagcgactac

SEQ ID NO: 7762 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctacttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7763 - DNA, 349 bp, Artificial
  Mutation in BnaC.FAD2.a introduced by TALE nuclease pair BnFAD2_T01
caggatccatgggtgcaggtggcagaatggaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccttggcctctctactgggcctgccaagggtgcgtcctaaccggcgtctgggtcatagcccacgagtgcggccaccacgccttcagcgactac

SEQ ID NO: 7764 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctggcctctctactgggcctgccaagggtgcgtcctaaccggcgtctgggtcatagcccacgagtgcggccaccacgccttcagcgactac

SEQ ID NO: 7765 - DNA, 345 bp, Artificial
  Mutation in BnaC.FAD2.a introduced by TALE nuclease pair BnFAD2_T01
caggatccatgggtgcaggtggaagaatgcaagtgtctcctccctccagcacgcctggaaccgacaccatcaagcgcgtaccctgcgagacaccacccttcactgtcggagaactcaagaaagcaatcccaccgcactgcttcaaacgctcgatccctcgctctttctcctaccccatctgggacatcgtcatagcctcctgcctccaccacctcgccaccccctacctccccctcctccctccccctctcccccaggcccctctactgggcctgccaaggctgcgtcctaacgggcgtctgggtcatagcccacgagtgcggccaccacgccttcagcgactac

SEQ ID NO: 7766 - DNA, 277 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactgcgcgccttcagcgactac

SEQ ID NO: 7767 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccccactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaaccggcgtctgggtcatagcccacgagtgcggccaccacgccttcagcgactac

SEQ ID NO: 7768 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctccgcctggcccctctactgggcctgccaaggctgcgtcctaacgggcctctgggtcatcgcccacgaatgcggccaccacgccttcagcgactac

SEQ ID NO: 7769 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaaggctgcgtcctaacgggcctctgggtcatagcccacgagtgcggccaccacgccttcagcgactac

SEQ ID NO: 7770 - DNA, 385 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccgtgggcctgccacagcaccgccaccagccgctggaccgtctccagcgcctgcctggcctctctactgggcctgccaagggtgcgtcctaaccggcgtctgggtcatagcccacgagtgcggccaccacgccttcagcgactac

SEQ ID NO: 7771 - DNA, 404 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttcgcttgccgccatcgtggctggcgatggccaccacctgctccggggtcaagccgtgggcctctctactgggcctgccaagggtgcgtcctaaccggcgtctgggtcatagcccacgagtgcggccaccacgccttcagcgactac

SEQ ID NO: 7772 - DNA, 358 bp, Artificial
  Mutation in BnaC.FAD2.a introduced by TALE nuclease pair BnFAD2_T01
caggatccatgggtgcaggtggcagaatgcaagtgtctaccccctcaaaaaagtctgaaaccgacaccatcaagcgcgtaccctgcgagacaccgcccttcactgtcggagaactcaagaaagcaatcccaccgcactgtttcaaacgctcgatccctcgctctttctcctccctcatctgggacatcatcatagcctcctgcttctactacgtcgccaccacttacttccctctcctccctcaccctctcccctacttcgcctaccctagcctctctactgggccggccatgagtgcggccgaaccggcgtcggggtcatagcccacgagtgcttccaccgcgccttcagcgactac

SEQ ID NO: 7773 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcttctctactgggcctgccaagggtgcgtcctaaccggcgtctgggtcatagcccacgagtgcggccaccacgccttcagcgactac

SEQ ID NO: 7774 - DNA, 395 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcaaactcttcctggctagcggtacgcgtattaattgcgtcctggcctctctactgggcctgccaagggtgcgtcctaaccggcgtctgggtcatagcccacgagtgcggccaccacgccttcagcgactac

SEQ ID NO: 7775 - DNA, 332 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacatcgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaaccggcgtctgggtcatagcccacgagtgcggccaccacgccttcagcgactac

SEQ ID NO: 7776 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaaccccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 7777 - DNA, 339 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaaggctgcgtcctaacgggcctctgggtcatagcccacgagtgcggccaccacgccttcagcgactac

SEQ ID NO: 7778 - DNA, 349 bp, Artificial
  Mutation in BnaC.FAD2.a introduced by TALE nuclease pair BnFAD2_T01
caggatccatgggtgcaggtggaagaatgcaagtgtctcctcactcccagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgcctgcagcgactac

SEQ ID NO: 7779 - DNA, 342 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcgcctggcccctctactgggcctgccaaggctgcgtcctaacgggcctctgggtcatagcccacgagtgcggccaccacgccttcagcgactac

SEQ ID NO: 7780 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtctgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccctggcctctctactgggcctgccaagggtgcgtcctaaccggcgtctgggtcatagcccacgagtgcggccaccacgccttcagcgactac

SEQ ID NO: 7781 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcggcctctctactgggcctgccaagggtgcgtcctaaccggcgtctgggtcatagcccacgagtgcggccaccacgccttcagcgactac

SEQ ID NO: 7782 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7783 - DNA, 345 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccctggcctctctactgggcctgccaagggtgcgtcctaaccggcgtctgggtcatagcccacgagtgcggccaccacgccttcagcgactac

SEQ ID NO: 7784 - DNA, 335 bp, Artificial
  Mutation in BnaC.FAD2.a introduced by TALE nuclease pair BnFAD2_T01
caggatccatgggtgcaggtggtagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgtcctaaccggcgtctgggtcatagcccacgagtgcggccaccacgccttcagcgactac

SEQ ID NO: 7785 - DNA, 343 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccggcctctctactgggcctgccaagggtgcgtcctaaccggcgtctgggtcatagcccacgagtgcggccaccacgccttcagcgactac

SEQ ID NO: 7786 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctcctctctactgggcctgccaagggtgcgtcctaaccggcgtctgggtcatagcccacgagtgcggccaccacgccttcagcgactac

SEQ ID NO: 7787 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccagcgtctgggtcatagcccacgagtgcggccaccacgccttcagcgactac

SEQ ID NO: 7788 - DNA, 349 bp, Artificial
  Mutation in BnaC.FAD2.a introduced by TALE nuclease pair BnFAD2_T01
caggatccatgggtgcaggtcgaagaatgcaattgtctcctccctccaataagtctgaaaccgacaccatcaagctcgtaccctgcgagacaccgcccttcactgtcggagaactcacgaaagcaatcccaccgcactgtttcaaacgctcgatccctcgctctttctcctacctcatctgggacatcatcatagcctcctgcttctactacgtcgccaccacttacttccctctcctccctcaccctctctcctactgtggcctctctactgggcctgccaagggtgcgtcctaaccggcgtctgggtcatagcccacgagtgcggccaccacgccttcagcgactac

SEQ ID NO: 7789 - DNA, 340 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctccctccctctactgggcctgccaaggctgcgtcctaacgggcgtctgggtcatagcccacgagtgcggccaccacgccttcagcgactac

SEQ ID NO: 7790 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcccctggcctctctacggggcctgccaagggtgcgtcctaaccggcgtctgggtcatagcccacgagtgcggccgccacgccttcagcgactac

SEQ ID NO: 7791 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccctcaagcgcgtaccctgcgagacaccgcccttcactgtcggagaactcaagaaagcaatcccaccgcactgtttcaaacgctcgatccctcgctctttctcctacctcatctggcacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 7792 - DNA, 347 bp, Artificial
  Mutation in BnaC.FAD2.a introduced by TALE nuclease pair BnFAD2_T01
caggatccatgggtgcaggcggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 7793 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctacctcaccctctctccttcggctctctactgggcctgccaagggtgcgtcctaaccggcgtctgggtcatagcccacgagtgcggccaccacgccttcagcgactac

SEQ ID NO: 7794 - DNA, 354 bp, Artificial
  Mutation in BnaC.FAD2.a introduced by TALE nuclease pair BnFAD2_T01
caggatccatgggtgcaggtggaagaatgcaagtctctactccatccagctcccccgaaaccaaaaccatcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacgtcgccctggcctctctactgggcctgccaagggtgcgtcctaaccggcgtctgggtcatggcccacgagtgcggccaccacgccttcagcgactac

SEQ ID NO: 7795 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactatgtcgccaccacttacttccctctcctccctcaccctctctcctacttgggcctctctactgggcctgccaagggtgcgtcctaacgggcctctgggtcatcgcccacgaatgcggccaccacgccttcagcgactac

SEQ ID NO: 7796 - DNA, 332 bp, Artificial
  Mutation in BnaC.FAD2.a introduced by TALE nuclease pair BnFAD2_T01
caggatccatgggtgcaggtggcagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcagcctctctactgggcctgccaagggtgcgtcctaaccggcgtctgggtcatagcccacgagtgcggccaccacgccttcagcgactac

SEQ ID NO: 7797 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 7798 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgtcaagggtgcgtcctaaccggcgtctgggtcatagcccacgagtgcggccaccacgccttcagcgactac

SEQ ID NO: 7799 - DNA, 352 bp, Artificial
  Mutation in BnaC.FAD2.a introduced by TALE nuclease pair BnFAD2_T01
caggatccatgtgtgcaggtggaagaatgcaagtgtctcctccctcccagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcatccctcaccctctctcctacttcgctggcctctctactgggcctgccaagggtgcgtcctaaccggcgtctgggtcatagcccacgagtgcggccaccacgccttcagcgactac

SEQ ID NO: 7800 - DNA, 277 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttcacgccttcagcgactac

SEQ ID NO: 7801 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaaggctgcgtcctaacgggcctctgggtcatcgcccacgaatgcggccaccacgccttcagcgactac

SEQ ID NO: 7802 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctggcctctctactgggcctgccaagggtgcgtcctaaccggcgtctgggtcatagcccacgagtgcggccaccacgccttcagcgactac

SEQ ID NO: 7803 - DNA, 324 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcgccaagggtgcgtcctaaccggcgtctgggtcatagcccacgagtgcggccaccacgccttcagcgactac

SEQ ID NO: 7804 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgccttcagcgactac

SEQ ID NO: 7805 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacctctctactgggcctgccaagggtgcgtcctaaccggcgtctgggtcatagcccacgagtgcggccaccacgccttcagcgactac

SEQ ID NO: 7806 - DNA, 345 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccactcctctctactgggcctgccaagggtgcgtcctaaccggcgtctgggtcataccccacgagtgcggccaccacgccttcagcgactac

SEQ ID NO: 7807 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7808 - DNA, 324 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcgccaagggtgcgtcctaaccggcctctgggtcatcgcccacgaatgcggccaccacgccttcagcgactac

SEQ ID NO: 7809 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaacgggcctctgggtcatagcccacgagtgcggccaccacgccttcagcgactac

SEQ ID NO: 7810 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctctcctaggcctctctactgggcctgccaagggtgcgtcctaaccggcgtctgggtcatagcccacgagtgcggccaccacgccttcagcgactac

SEQ ID NO: 7811 - DNA, 473 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcccagtctcatattcactctcaatccaaataatctgcaccggatctcgccctatcagccgtccccagctggtgaagtccgagctggaggagaagaataatggtggcaagcaggcgctggagtccctggcctctctactgggcctgccaagggtgcgtcctaaccggcgtctgggtcatagcccacgagtgcggccaccacgccttcagcgactac

SEQ ID NO: 7812 - DNA, 462 bp, Artificial
  Mutation in BnaC.FAD2.a introduced by TALE nuclease pair BnFAD2_T01
caggatccatgggtgcaggtggcaggatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctccgacgcccgcgttgaccaacgacccccgcgtcgccttggcctgcctcggcgggcgtcctgcgctggatgcagtgaaaaagggattgggggatcctatcagccgttcccagctggacgcctggcctctctactgggcctgccaagggtgcgtcctaacgggcctctgggtcatagcccacgagtgcggccaccacgccttcagcgactac

SEQ ID NO: 7813 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttctctactgggccggccaagggtgcgtcctaaccggcgtctgggtcatagcccacgagtgctgccaccacgccttcagcgactac

SEQ ID NO: 7814 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgctcctggcctctctactgggcctgccaagggtgcgtcctaacgggcctctgggtcatcgcccacgaatgcggccaccacgccttcagcgactac

SEQ ID NO: 7815 - DNA, 343 bp, Artificial
  Mutation in BnaC.FAD2.a introduced by TALE nuclease pair BnFAD2_T01
caggatccatgggtgcaggtggcagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcgtccaccacgccttcagcgactac

SEQ ID NO: 7816 - DNA, 347 bp, Artificial
  Mutation in BnaC.FAD2.a introduced by TALE nuclease pair BnFAD2_T01
caggatccatgggtgcaggtggcagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctcctctctactgggcctgccaagggtgcgtcctaaccggcgtctgggtcatagcccacgagtgcggccaccacgccttcagcgactac

SEQ ID NO: 7817 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctcgcctctctactgggcctgccaagagtgcgtcctaaccggcggctgcgtcatagcccacgagtgcggccaccacgccttcagcgactac

SEQ ID NO: 7818 - DNA, 343 bp, Artificial
  Mutation in BnaC.FAD2.a introduced by TALE nuclease pair BnFAD2_T01
caggatccatgggtgcaggtagaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 7819 - DNA, 334 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccacgagtgcggccaccacgccttcagcgactac

SEQ ID NO: 7820 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctaccgggcctgccaagggtgcgtcctaaccggcgtctgggtcatagcccacgagtgcggccaccacgccttcagcgactac

SEQ ID NO: 7821 - DNA, 343 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 7822 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaacgggcctctgggtcatcgcccacgaatgcggccaccacgccttcagcgactac

SEQ ID NO: 7823 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgttccctcgctctttctcctacctcatctgggacatcatcatagcctcctgcttctactacgtcgccaccacttacttccctctcctccctcaccctctctctactgggcctgccaagggtgcgtcctaaccagcgtctgggtcatagcccacgagtgcggccaccacgccttcagcgactac

SEQ ID NO: 7824 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaagggtgcgtcctaacgggcctctgggtcatagcccacgagtgcggccaccacgccttcagcgactac

SEQ ID NO: 7825 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 7826 - DNA, 347 bp, Artificial
  Mutation in BnaC.FAD2.a introduced by TALE nuclease pair BnFAD2_T01
caggatccatgggtgcaggtggcagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttacctctctactgggcctgccaagggtgcgtcctaaccggcgtctgggtcatagcccacgagtgcggccaccacgccttcagcgactac

SEQ ID NO: 7827 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggcaaccacgccttcagcgactac

SEQ ID NO: 7828 - DNA, 390 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacactgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcggtggcaagcacctgctggggggtcaagccgtgggcggcctctctactgggcctgccaagggtgcgtcctaaccggcgtctgggtcatagcccacgagtgcggccaccacgccttcagcgactac

SEQ ID NO: 7829 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccaagggtgcgtcctaaccggcgtctgggtcatagcccacgagtgcggccaccacgccttcagcgactac

SEQ ID NO: 7830 - DNA, 335 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccaagggtgcgtcctaaccggcctctgggtcatagcccacgagtgcggccaccacgccttcagcgactac

SEQ ID NO: 7831 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaagggtgcgtcctaaccggcgtctgggtcatagcccacgagtgcggccaccacgccttcagcgactac

SEQ ID NO: 7832 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccaccagtgcggccaccacgccttcagcgactac

SEQ ID NO: 7833 - DNA, 321 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaacgggcctctgggtcatcgcccacgaatgcggccaccacgccttcagcgactac

SEQ ID NO: 7834 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccttctcctccctcaccctctctcctacttcgccctggcctctctactgggcctgccaagggtgcgtcctaaccggcgtctgggtcatagcccacgagtgcggccaccacgccttcagcgactac

SEQ ID NO: 7835 - DNA, 340 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccaagggtgcgtcctaaccggcgtctgggtcatagcccacgagtgcggccaccacgccttcagcgactac

SEQ ID NO: 7836 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 7837 - DNA, 386 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctccttggcccccacctgctggggggtcaagccgtgggcctggcacagtctctactgggcctgccaaggctgcgtcctaacgggcctctgggtcatagcccacgagtgcggccaccacgccttcagcgactac

SEQ ID NO: 7838 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttcgcccctggcctctctactgggcctgccaagggtgcgtcctaaccggcgtctgggtcatagcccacgagtgcggccaccacgccttcagcgactac

SEQ ID NO: 7839 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttccgcgactac

SEQ ID NO: 7840 - DNA, 347 bp, Artificial
  Mutation in BnaC.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccacctcactgcttcaaacgctccatccctcgctccttctcctacctcatctgggacatcatcatagcctcctgcttctactacgtcgccaccacttacttccctctcctccctcaccctctctcctaatggcctctctactgggcctgccaagggtgcgtcctaaccggcgtctgggtcatagcccacgagtgcggccaccacgccttcagcgactac

SEQ ID NO: 7841 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccgcgagtgcggccaccacgccttcagcgactac

SEQ ID NO: 7842 - DNA, 356 bp, Artificial
  Mutation in BnaC.FAD2.a introduced by TALE nuclease pair BnFAD2_T01
caggatccatgggtgcagggggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggccggccaagggtgcgtcctaaccggcgtctgggtcatagcccacgagtgcggccaccacgccttcagcgactac

SEQ ID NO: 7843 - DNA, 339 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgtttcaaacgctcgatccctcgctctttctcctacctcatctgggacatcatcatagcctcctgcttctactacgtcgccaccacttacttccctctcctccctcaccctctctcctctctacggggcctgccaagggtgcgtcctaacgggcctctgggtcatagcccacgagtgcggccaccacgcctgcagcgactac

SEQ ID NO: 7844 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctcggacatcatcatagcctcctgcttctactacgtcgccaccacttacttccctctcctccctcaccctctctcctacttccgcctggcctctctactgggcctgccaagggtgcgtcctaaccggcgtctgggtcatagcccacgagtgcggccaccacgccttcagcgactac

SEQ ID NO: 7845 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 7846 - DNA, 389 bp, Artificial
  Mutation in BnaC.FAD2.a introduced by TALE nuclease pair BnFAD2_T01
caggatccatgggtgcaggtggaagaatgcaagtgtctactacctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgttggcgatggccaccacctgctggggggtcaagccgtgggcggcctctctactgggcctgccaagggtgcgtcctaaccggcgtctgggtcatagcccacgagtgcggcaaccacgccgcagcgactac

SEQ ID NO: 7847 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctccttcggcctctctacggggcctgccaagggtgcgtcctacccggcgtctgggtcatagcccacgagtgcggcccccccgccttcagcgactac

SEQ ID NO: 7848 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatatcccacgagtgcggccaccacgccttcagcgactac

SEQ ID NO: 7849 - DNA, 277 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcgccttcagcgactac

SEQ ID NO: 7850 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcctctgggtcatagcccacgagtgcggccaccacgccttcagcgactac

SEQ ID NO: 7851 - DNA, 323 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctaagggtgcgtcctaaccggcgtctgggtcatagcccacgagtgcggccaccacgccttcagcgactac

SEQ ID NO: 7852 - DNA, 325 bp, Artificial
  Mutation in BnaC.FAD2.a introduced by TALE nuclease pair BnFAD2_T01
caggatccatgggtgcaggtagaagaatgcaagtgtctcctccctccaagaagtccgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggctgcgtcctaacgggcctctgggtcatagcccacgagtgcggccaccacgccttcagcgactac

SEQ ID NO: 7853 - DNA, 401 bp, Artificial
  Mutation in BnaC.FAD2.a introduced by TALE nuclease pair BnFAD2_T01
taggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccataaactgccaggcatcaaactaagcagaaggccatccgtccataggctggcctctctactgggcctgccaagggtgcgtcctaaccggcgtctgggtcatagcccacgagtgcggccaccacgccttcagcgactac

SEQ ID NO: 7854 - DNA, 343 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctactacctctctactgggcctgccaagggtgcgtcctaaccggcgtctgggtcatagcccacgagtgcggccaccacgccttcagcgactac

SEQ ID NO: 7855 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccctggcctctctactgggcctgccaaggctgcgtcctaacgggcctctgggtcatagcccacgagtgcggccaccacgccttcagcgactac

SEQ ID NO: 7856 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccgagggtgcgtcctaaccggcgtctgggtcatagcccacgagtgcggccaccacgccttcagcgactac

SEQ ID NO: 7857 - DNA, 343 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctatcctccctcaccctctctcctacctctctactgagcctgccaagggtgcgtcctaaccggcgtctgggtcatagcccacgagtgcggccaccacgccttcagcgactac

SEQ ID NO: 7858 - DNA, 348 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagccctcgagtgcggccaccacgccttcagcgactac

SEQ ID NO: 7859 - DNA, 398 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgccaacttctcaagattgcaaaacgtggcggcgtgaccgcagtggaggcagtgcatgcgcctctctactgggcctgccaagggtgcgtcctaaccggcgtctgggtcatagcccacgagtgcggccaccacgccttcagcgactac

SEQ ID NO: 7860 - DNA, 347 bp, Artificial
  Mutation in BnaC.FAD2.a introduced by TALE nuclease pair BnFAD2_T01
caggatccatgggtgcaggtgcaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattggcctctctactgggcctgccaagggtgcgtcctaaccggcgtctgggtcatagcccaccagtgcggccaccacgccttcagcgactac

SEQ ID NO: 7861 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatcccacgctccttctcctcttcgacatcatcatctcctcctcggctcctccctctaccacctctccacagcctacttccctctcctccctcaccctctctcctaggcctctctactgggcctgccaagggtgcgtcctaaccggcgtctgggtcatagcccacgagtgcggccaccacgccttcagcgatac

SEQ ID NO: 7862 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctaaccctctctcctcctctggcctctctactgggcctgccaagggtgcgtcctaaccggcgtctgggtcatagcccacgagtgcggccaccacgccttcagcgactac

SEQ ID NO: 7863 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 7864 - DNA, 349 bp, Artificial
  Mutation in BnaC.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaacgggcctctgggtcatcgcccacgaatgcggccaccacgccatcagcgactac

SEQ ID NO: 7865 - DNA, 347 bp, Artificial
  Mutation in BnaC.FAD2.a introduced by TALE nuclease pair BnFAD2_T01
caggatccatgggtgcaggtggaagaatgcaagtgtatcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 7866 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 7867 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccgcctggcccctctactgggcctgccaaggctgcgtcctaacgggcctctgggtcatcgcccacgaatgcggccaccacgccttcagcgactac

SEQ ID NO: 7868 - DNA, 338 bp, Artificial
  Mutation in BnaC.FAD2.a introduced by TALE nuclease pair BnFAD2_T01
caggatccatgggtgcaggcggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaaggctgcgtcctaaccggcgtctgggtcatagcccacgagtgcggccaccacgccttcagcgactac

SEQ ID NO: 7869 - DNA, 339 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctctctactgggcctgccaagggtgcgtcctaaccggcgtctgggtcatagcccacgagtgcggccaccacgccttcagcgactac

SEQ ID NO: 7870 - DNA, 351 bp, Artificial
  Mutation in BnaC.FAD2.a introduced by TALE nuclease pair BnFAD2_T01
caggatccatgggtgcaggtggcagaatgcaagtctctcctccctcccgctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcccctctactgggcctgccaaggctgcgtcctaacggacctctgggtcatcgcgcgcgaatgcggccaccacgccttcagcgactac

SEQ ID NO: 7871 - DNA, 349 bp, Artificial
  Mutation in BnaC.FAD2.a introduced by TALE nuclease pair BnFAD2_T01
caggatcatgggtgcaggtggaagaatgcaattgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 7872 - DNA, 349 bp, Artificial
  Mutation in BnaC.FAD2.a introduced by TALE nuclease pair BnFAD2_T01
caggatccatgggtgcagttggaagaatgcaagtgtctcctccctccaagaagtctgaaaccgacaccatcaagcgcgtaccctgcgagacaccgcccttcactgtcggagaactcaagaaagcaatcccaccgcactgtttcgaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7873 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtctgagaactcaagaaagcaatcccaccgcactgtttcaaacgctcgatccctcgctctttctcctacctcatctgggacatcatcatagcctcctgcttctactacgtcgccaccacttacttccctctcctccctcaccctcgcctggcctctctactgggcctgccaagggtgcgtcctaaccggcgtctgggtcatagcccacgagtgcggccaccacgccttcagcgactac

SEQ ID NO: 7874 - DNA, 351 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaaccggcgtctgggtcatagcccacgagtgcggccaccacgccttcagcgactac

SEQ ID NO: 7875 - DNA, 414 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccggcaaaatcgcgccgaaggatgtcgctgccgactgggcaatggagcgcctgccggcccacctggcctctctactgggcctgccaagggtgcgtcctaaccggcgtctgggtcatagcccacgagtgcggccaccacgccttcagcgactac

SEQ ID NO: 7876 - DNA, 351 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcctggcctctctactgggcctgccaagggtgcgtcctaaccggcgtctgggtcatagcccacgagtgcggccaccacgccttcagcgactac

SEQ ID NO: 7877 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 7878 - DNA, 393 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctaacggtgcaggcgctgttgccggtgctgtgccaggcccacggcttgacccctggcctctctactgggcctgccaagggtgcgtcctaaccggcgtctgggtcatagcccacgagtgcggccacctcgccttcagcgactac

SEQ ID NO: 7879 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 7880 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggccggccaaggctgcgtcctaacgggcctctgggtcatagcccacgagtgcggccaccacgccttcagcgactac

SEQ ID NO: 7881 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcggcctaaccggcgtctgggtcatagcccacgagtgcggccaccacggcttccagcgactac

SEQ ID NO: 7882 - DNA, 334 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctgccaagggtgcgtcctaaccggcgtctgggtcatagcccacgagtgcggccaccacgccttcagcgactac

SEQ ID NO: 7883 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcctgccaagggtgcgtcctaaccggcgtctgggtcacagcccacgagtgcggccaccacgccttcagcgactac

SEQ ID NO: 7884 - DNA, 323 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgtttcaaacgctcgatccctcgctctttctcctacctcatctgggacatcatcatagcctcctgcttctactacgtcgccaccacttacttccctcgagccacccactgggcctgccaagggtgcgtcctaaccggcgtctgggtcatagcccacgagtgcggccaccacgccttcagcgactac

SEQ ID NO: 7885 - DNA, 323 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcatctgggacatcatcatagcctcctgcttctactacgtcgccaccacttacttccctcgagccacccactgggcctgccaagggtgcgtcctaaccggcgtctgggtcatagcccacgagtgcggccaccacgccttcagcgactac

SEQ ID NO: 7886 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacatcatctgggacatcatcatagcctcctgcttctactacgtcgccaccacttacttccctctcctccctcaccctctctcctacttcggggcctctctactgggcctgccaagggtgcgtcctaaccggcgtctgggtcatagcccacgagtgcggccaccacgccttcagcgactac

SEQ ID NO: 7887 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttctggcctctctactgggcctgccaagggtgcgtcctaaccggcgtctgggtcatagcccacgagtgcggccaccacgccttcagcgactac

SEQ ID NO: 7888 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcctgccaagggtgcgtcctaaccggcgtctgggtcatagcccacgagtgcggccaccacgccttcagcgactac

SEQ ID NO: 7889 - DNA, 348 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaaggctgcgtcctaacgggcctctgggtcatcgcccacgaatgcggccaccacgccttcagcgactac

SEQ ID NO: 7890 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgggcctctctactgggcctgccaagggtgcgtcctaacgggcctctgggtcatagcccacgagtgcggccaccacgccttcagcgactac

SEQ ID NO: 7891 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcccctctactgggcctgccaaggctgcgtcctaacgggcctctgggtcatcgcccacgaatgcggccaccacgccttcagcgactac

SEQ ID NO: 7892 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctggggcatcatcatagcctcctgcttctactacgtcgccaccacttacttcgctctcctccctcaccctctctccaactggcctctctactgggcctgccaagggtgcgtcctaaccggcgtctgggtcatagcccgcgagtgcggccaccacgccttcagcgactac

SEQ ID NO: 7893 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagtccacgagtgcggccaccacgccttcagcgactac

SEQ ID NO: 7894 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaaggctgcgtcctaacgggcctctgggtcatcgcccacgaatgcggccaccacgccttcagcgactac

SEQ ID NO: 7895 - DNA, 323 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagggtgcgtcctaacgggcctctgggtcatcgcccacgaatgcggccaccacgccttcagcgactac

SEQ ID NO: 7896 - DNA, 312 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 7897 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctggcctctctactgggcctgccaagggtgcgtcctaaccggcgtctgggtcatatcccacgagtgcggccaccacgcctgcagcgactac

SEQ ID NO: 7898 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaattccaccgcactgtttcaaacgctcgatccctcgctctttctcctacctcatctgggacatcatcatagcctcctgcttctactacgtcgccaccacttacttccctctcctccctcaccctctctcctacttcgccttggcctctctactgggcctgccaagggtgcgtcctaaccggcgtctgggtcatagcccacgagtgcggccaccacgccttcagcgactac

SEQ ID NO: 7899 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgctgccaccacgccttcagcgactac

SEQ ID NO: 7900 - DNA, 337 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctctactgggcctgccaagggtgcgtcctaaccggcgtctgggtcatagcccacgagtgcggccaccacgccttcagcgactac

SEQ ID NO: 7901 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaacctacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 7902 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccttggcctctctactgggcctgccaaggctgcgtcctaaccggcgtctgggtcatagcccacgagtgcggccaccacgccttcagcgactac

SEQ ID NO: 7903 - DNA, 312 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccatcagcgactac

SEQ ID NO: 7904 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactggtcctgccaagggtgcgtcctaaccggcgtctgggtcatagcgcactagtgcggccaccacgccttcagcgactac

SEQ ID NO: 7905 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcggcctaaccggcgtctgggtcatatcccacgagtgcggccaccacgccttcagcgactac

SEQ ID NO: 7906 - DNA, 387 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccaattacttccctctcctccctcaccctctctcctccttcgccgccatcgtggctggcgatggccaccacctgcccctggcctctctactgggcctgccaagggtgcgtcctaaccggcgtctgggtcatagcccacgagtgcggccaccacgccttcagcgactac

SEQ ID NO: 7907 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctattgggcctgccaagggtgcgtcctaaccggcgtctgggtcatagcccacgagtgcggccaccacgccttcagcgactac

SEQ ID NO: 7908 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgctagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgaggcctctctactgggcctgccaagggtgcgtcctaaccggcgtctgggtcatagcccacgagtgcggccaccacgccttcagcgactac

SEQ ID NO: 7909 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactctcggagaactcaagaaagcaatcccacctcactgcttcaaacgctcgatccctcgctctttctcctcccccatctcgtcctccctcataccctcctgcctctaccacgtcgcctccacttacttccctctcccccctcaccctctctcctccttcgccgcctggcctctctactgggcctgccaagggtgcgtcctaacgggcgtctgggtcatagcccacgagtgcggccaccacgccttcagcgactac

SEQ ID NO: 7910 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgccgccaccacttacttccctctcctccctcaccctctctcccggcctctctactgggcctgccaaggctgcgtcctaacgggcctctgggtcatagcccacgagtgcggccaccacgccttcagcgactac

SEQ ID NO: 7911 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgcctgcagcgactac

SEQ ID NO: 7912 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctacgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 7913 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtcctaaccggcgtctgggtcatagcccacgagtgcggccaccacgccgtcagcgactac

SEQ ID NO: 7914 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttgctggcctctctactgggcctgccaagggtgcgtcctaaccggcgtctgggtcatagcccacgagtgcggccaccacgccttcagcgactac

SEQ ID NO: 7915 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaacctgcgtctgggtcatagcccacgagtgcggccaccacgccttcagcgactac

SEQ ID NO: 7916 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 7917 - DNA, 277 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttcgcgccttcagcgactac

SEQ ID NO: 7918 - DNA, 355 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 7919 - DNA, 349 bp, Artificial
  Mutation in BnaC.FAD2.a introduced by TALE nuclease pair BnFAD2_T01
caggatccatgagtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctctccctctctcctacgtcggcctctctactgggcctgccaagggtgcgtcctaaccggcgtctgggtcatagcccacgagtgcggccaccacgcctgcagcgactac

SEQ ID NO: 7920 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctactctggcctctctactgggcctgccaagggtgcgtcctaaccggcgtctgggtcatagcccacgagtgcggccaccacgccttcagcgactac

SEQ ID NO: 7921 - DNA, 340 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgctctactgggcctgccacggctgcgtccgaaccggcgtctgggtcatagcccacgagtgcggccaccacgccatcagcaactac

SEQ ID NO: 7922 - DNA, 346 bp, Artificial
  Mutation in BnaC.FAD2.a introduced by TALE nuclease pair BnFAD2_T01
caggatccatgggtgcaggtgggagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 7923 - DNA, 341 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctctactgggcctgccaagggtgcgtcctaaccggcgtctgggtcatagcccacgagtgcggccaccacgccttcagcgactac

SEQ ID NO: 7924 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctacttgcctctctactgggcctgccaagggtgcgtccaaaccggcgtctgggtcatagcccacgagtgcggccaccacgcctgcatcgactac

SEQ ID NO: 7925 - DNA, 401 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccataaactgccaggcatcaaactaagcagaaggccatccgtccataggctggcctctctactgggcctgccaagggtgcgtcctaaccggcgtctgggtcatagcccacgagtgcggccaccacgccttcagcgactac

SEQ ID NO: 7926 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaattccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7927 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaaggctgcgtcctaacgggcctctgggtcatagcccacgagtgcggccaccacgccttcagcgactac

SEQ ID NO: 7928 - DNA, 339 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccaagggtgcgtcctaaccggcgtctgggtcatagcccacgagtgcggccaccacgccttcagcgactac

SEQ ID NO: 7929 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactctggcctctctactgggcctgcctagggtgcgtcctaaccggcgtctgggtcatagcccacgagtgcggccaccacgccttcagcgactac

SEQ ID NO: 7930 - DNA, 347 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 7931 - DNA, 419 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcaggcgctgttgccggtgctgtgccaggcccacggcttgaccccccagcaggtggtggccatcgccagatggcctctcttctgggcctgccaagggtgcgtcctaaccggcgtctgggtcatagcccacgagtgcggccaccacgccttcagcgactac

SEQ ID NO: 7932 - DNA, 351 bp, Artificial
  Mutation in BnaC.FAD2.a introduced by TALE nuclease pair BnFAD2_T01
caggatccatgggtgcaggtgggagaatgcaagtgactcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaaccggcgtctgggtcatagcccacgattgcggccaccacgccatcagcgactac

SEQ ID NO: 7933 - DNA, 345 bp, Artificial
  Mutation in BnaC.FAD2.a introduced by TALE nuclease pair BnFAD2_T01
caggatccatgggtgcaggtggaagaatgcaagtgtctcctccctccaaaaagtcttaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcggctctctactgggccggccaagggtgcgtcctaaccggcgtctgggtcatagccctcgagtgcggccgccacgccttcagcgactac

SEQ ID NO: 7934 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaaccggcgtctgggtcatagcccacgaatgcggccaccacgccttcagcgactac

SEQ ID NO: 7935 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggataactcaagaaagcaatcccaccgcactgtttcaaacgctcgatccctcgctctttctcctacctcatctgggacatcatcatagcctcctgcttctactacttcgccaccacttacttccctctcctccctcaccctctctcctactgtggcctctctactgggcctgccaagggtgcgtcctaaccggcgtctgggtcatagcccacgagtgcggccaccacgccttcagcgactac

SEQ ID NO: 7936 - DNA, 339 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgggtcatagcccacgagtgcggccaccacgccttcagcgactac

SEQ ID NO: 7937 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaacgggcgtctgggtcatatcccacgagtgcggccaccacgccttcagcgactac

SEQ ID NO: 7938 - DNA, 347 bp, Artificial
  Mutation in BnaC.FAD2.a introduced by TALE nuclease pair BnFAD2_T01
caggatccatggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccatctcctccctcaccctctctcctgcctggcctctctactgggcctgccaagggtgcgtcctaaccggcgtctgggtcatagcccacgagtgcggccaccacgccttcagcgactac

SEQ ID NO: 7939 - DNA, 323 bp, Artificial
  Mutation in BnaC.FAD2.a introduced by TALE nuclease pair BnFAD2_T01
caggatccatgggtgcaggtggaagaatgcaagtgtctcctccctccaagaagtctaaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagggtgcgtcctaaccggcgtctgggtcatagcccacgagtgcggccaccacgccttcagcgactac

SEQ ID NO: 7940 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgccttcagcgactac

SEQ ID NO: 7941 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccaagggtgcgtcctaaccggcgtctgggtcatagctcacgagtgcggccaccacgccttcagcgactac

SEQ ID NO: 7942 - DNA, 358 bp, Artificial
  Mutation in BnaC.FAD2.a introduced by TALE nuclease pair BnFAD2_T01
caggatccatgggtgcaggtggaagaatgcaagtgcctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctaacctggcctctctactgggcctgccaagggtgcgtcctaaccggcgtctgggtcatagcccacgagtgcggccaccacgccttcagcgactac

SEQ ID NO: 7943 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaaggctgcgtcctaacgggcctctgggtcatagcccacgagtgcggccaccacgccttcagcgactac

SEQ ID NO: 7944 - DNA, 323 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtccccaccacttacttccctcgacccacccactgggcctgccaaggctgcgtcctaacgggcctctgggtcatagcccacgagtgcggccaccacgccttcagcgactac

SEQ ID NO: 7945 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactggacctgccaagggtgcgtcctaaccggcgtctgggtcatagcccacgagtgcggccaccacgccttcagcgactac

SEQ ID NO: 7946 - DNA, 321 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaaccggcgtcttggtcatagcccacgagtgcggccaccacgccttcagcgactac

SEQ ID NO: 7947 - DNA, 394 bp, Artificial
  Mutation in BnaC.FAD2.a introduced by TALE nuclease pair BnFAD2_T01
caggatccatgggtgcaggtgggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctaacggtgcaggcgctgttgccggtgctgtgccaggcccacggcttgacccctggcctctctactgggcctgccaagggtgcgtcctaaccggcgtctgggtcatagcccacgagtgcggccaccacgccttcagcgactac

SEQ ID NO: 7948 - DNA, 355 bp, Artificial
  Mutation in BnaC.FAD2.a introduced by TALE nuclease pair BnFAD2_T01
caggatccatgggtgcaggtggcagaatgcaagtctctcctccctccagctcccccggaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcccctggcctctctactgggcctgccaagggtgcgtcctaaccggcgtctgggtcatagcccacgagtgcggccaccacgccttcagcgactac

SEQ ID NO: 7949 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaaccggcgtctgggtcatatcccacgagtgcggccaccacgccttcagcgactac

SEQ ID NO: 7950 - DNA, 346 bp, Artificial
  Mutation in BnaC.FAD2.a introduced by TALE nuclease pair BnFAD2_T01
caggatccatgggtgcagatggaagaatgcaagtgcctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaaccggcgtctgggtcatagcccacgagtgcggccgccactcctttagcgactac

SEQ ID NO: 7951 - DNA, 350 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctatcctccctcaccctctctcctgctgctggcctctctacggggcctgccaagggtgcgtccgaaccggcgtctgggtcatagcccgcaagtgcggcctccacgccatcagcaactac

SEQ ID NO: 7952 - DNA, 350 bp, Artificial
  Mutation in BnaC.FAD2.a introduced by TALE nuclease pair BnFAD2_T01
caggatccatgggtgcaggtggcagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttggcctctctactgggcctgccaagggtgcgtcctaaccggcgtctgggtcatagcccacgagtgcggccaccacgccttcagcgactac

SEQ ID NO: 7953 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccctcaaacgcgtaccctgcgagacaccgcccttcactgtcggagaactcaagaaagcaatcccaccccactgtttcaaacgctcgatccctcgctctttctcctacctcatctgggacatcatcatagcctcctgcttctactacgtcgccaccacttacttccctctcctccctcaccctctcccctacctccccctggcccctctactgggcctgccaagggtgcgtcctaaccggcgtctgggtcatagcccacgagtgcggccaccacgccttcagcgactac

SEQ ID NO: 7954 - DNA, 348 bp, Artificial
  Mutation in BnaC.FAD2.a introduced by TALE nuclease pair BnFAD2_T01
caggatccatgggtgcaggtggaagaatgcaagtgcctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaaggctgcgtcctaacgggcctctgggtcatagcccacgagtgcggccaccacgccttcagcgactac

SEQ ID NO: 7955 - DNA, 350 bp, Artificial
  Mutation in BnaC.FAD2.a introduced by TALE nuclease pair BnFAD2_T01
caggatccatgggtgcaggtggaagaatgcaagtgtctcctccctccaaaaagactgaaaccgacaccatcaagcgcgtaccctgcgagacaccgcccttcactgtcggagaactcaagaaagcaatcccaccgcactgcttcaaacgctcgatcccacgctccttctcctcttcgacatcatcatctcctcctcggctcctccctctaccacctctccacagcctacttccctctcctccctcaccctctctcctccgctggcctctctactgggcctgccaagggtgcgtcctaaccggcgtctgggtcatagcccacgagtgcggccaccacgccttcagcgactac

SEQ ID NO: 7956 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctaactctctactgggcctgccaagggtgcgtcctaaccggcgtctgggtcatagcccacgagtgcggccaccacgccttcagcgactac

SEQ ID NO: 7957 - DNA, 347 bp, Artificial
  Mutation in BnaC.FAD2.a introduced by TALE nuclease pair BnFAD2_T01
caggatccatgggtgcaggtggaagaatgcaagtctctcctccatccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 7958 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcataccctcctccttctactccgccgccaccacttacttccctctcctccctccccctctctcctacttggcctctctactgggcctgccaaggctgcgtcctaacgggcctctgggtcatagcccacgagtgcggccaccacgccttcagcgactac

SEQ ID NO: 7959 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgccactggcctctctactgggcctgccaagggtgcgtcctaaccggcgtctgggtcatagcccacgagtgcggccaccacgccttcagcgactac

SEQ ID NO: 7960 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttggcctctctactgggcctgccaagggtgcgtcctaaccggcgtctgggtcatagcccacgagtgcggccaccacgccttcagcgactac

SEQ ID NO: 7961 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgcctctctactgggcctgccaagggtgcgtcctaaccggcgtctgggtcatagcccacgagtgcggccaccacgccttcagctactac

SEQ ID NO: 7962 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactttgcctctctactgggccggccaagggtgcgtcctaacgggcctctgggtcataaccctccagtgcggccaccacgccttcagcgactac

SEQ ID NO: 7963 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttcccctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgacgac

SEQ ID NO: 7964 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcttccctcaccctctctcctacttggcctctctactgggcctgccaagggtgcgtcctaaccggcgtctgggtcatagcccacgagtgcggccaccacgccttcagcgactac

SEQ ID NO: 7965 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7966 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctacgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgccttcagcgactac

SEQ ID NO: 7967 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgcctgcagcgactac

SEQ ID NO: 7968 - DNA, 347 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 7969 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 7970 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaggaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 7971 - DNA, 350 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 7972 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccgccacgccttcagcgactac

SEQ ID NO: 7973 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 7974 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctcaccggcgtctgggtcatagcccacgagtgcggccaccacgccttcagcgactac

SEQ ID NO: 7975 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcattgcccacgagtgcggccaccacgccttcagcgactac

SEQ ID NO: 7976 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctcctctctactgggcctgccaagggtgcgtcctaaccggcgtctgggtcatagcccacgagtgcggccaccacgccttcagcgactac

SEQ ID NO: 7977 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 7978 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaaggctgaaaccgacaccatcaagcgcgtaccctgcgagacaccgcccttcactgtcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccccctcggcctctctactgggcctgccaagggtgcgtcctaaccggcgtctgggtcatagcccacgagtgcggccaccacgccttcagcgactac

SEQ ID NO: 7979 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 7980 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaagggtgcgtcctaacgggcctctgggtcatcgcccacgaatgcggccaccacgccttcagcgactac

SEQ ID NO: 7981 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcagcctctctactgggcctgccaagggtgcgtcctaacgggcctctgggtcatcgcccacgagtgctgccaccacgccttcagcgactac

SEQ ID NO: 7982 - DNA, 343 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccactagtgcggccaccacgccttcagcgactac

SEQ ID NO: 7983 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactgcgtcgccaccacttacttccctctcctccctcaccctctctcctactcctctctactgggcctgccaagggtgcgtcctaaccggcgtctgggtcatagcccacgagtgcggccaccacgccttcagcgactac

SEQ ID NO: 7984 - DNA, 348 bp, Artificial
  Mutation in BnaC.FAD2.a introduced by TALE nuclease pair BnFAD2_T01
caggatccatgggtgcaggtgcaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgcctgcagcgactac

SEQ ID NO: 7985 - DNA, 347 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatcgcccacgaatgcggccaccacgccttcagcgactac

SEQ ID NO: 7986 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgggcctctctacggggcctgccaagggtgcgtcctaaccggcgtctgggtcatagcccacgagtgcggccaccacgccttcagcgactac

SEQ ID NO: 7987 - DNA, 354 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccaagggtgcgtcctaaccggcgtctgggtcatagcccacgagtgcggccaccacgccttcagcgactac

SEQ ID NO: 7988 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgtgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccaagggtgcgtcctaaccggcgtctgggtcatagcccacgagtgcggccaccacgccttcagcgactac

SEQ ID NO: 7989 - DNA, 378 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgcccccagcgcctgcttgccgccatcgtggctggcgatggccaccacctgctccggggtcaagccgtgagggctgggtcatagcccacgagtgcggccaccacgccttcagcgactac

SEQ ID NO: 7990 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctccctcatctgagacatcatcatagcctcctgcttctactacgtcgccaccacttacttccctctcctccctcaccctctctcctgactctctactgggcctgccaagggtgcgtcctaaccggcgtctgggtcatagcccacgagtgcggccaccacgccttcagcgactac

SEQ ID NO: 7991 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgggcctgccaagggtgcgtcctaaccggcgtctgggtcatagcccacgagtgcggccaccacgccttcagcgactac

SEQ ID NO: 7992 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatccaaccgcactgtttcaaacgctcgatccctcgctctttctcctacctcatctgggacatcatcatagcctcctgcttctactacgtcgccaccacttacttccctctcctccctcaccctctctcctacttacctctctactgggcctgccaagggtgcgtcctaaccggcgtctgggtcatagcccacgagtgcggccaccacgccttcagcgactac

SEQ ID NO: 7993 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 7994 - DNA, 329 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgccaagggtgcgtcctaaccggcgtctgggtcatagcccacgagtgcggccaccacgccttcagcgactac

SEQ ID NO: 7995 - DNA, 324 bp, Artificial
  Mutation in BnaC.FAD2.a introduced by TALE nuclease pair BnFAD2_T01
caggatccatgggtgcaggtggaagaatgcaagtctctcctccctccagctcccccggaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcttgccaagggtgcgtcctaaccggcgtctgggtcatagcccacgagtgcggccaccacgccttcagcgactac

SEQ ID NO: 7996 - DNA, 348 bp, Artificial
  Mutation in BnaC.FAD2.a introduced by TALE nuclease pair BnFAD2_T01
caggatccgtgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 7997 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggggtctgggtcatagcccacgagtgcggccaccacgccttcagcgactac

SEQ ID NO: 7998 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcggcccctctactgggcctgccaaggctgcgtcctaacgggcctctgggtcatcgcccacgaatgcggccaccacgccttcagcgactac

SEQ ID NO: 7999 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgcttcaaacgctcgatccctcgctctttctcctacctcatctgggacatcatcatagcctcctgcttctactacgtcgccaccacttacttccctctcctccctcaccctctctcccacttggcctctctactgggcctgccaagggtgcgtcctaaccggcgtctgggtcatagcccacgagtgcggccaccacgccttcagcgactac

SEQ ID NO: 8000 - DNA, 438 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttaatgtttaactttgttttagggcgactgccctgctgcgtaacatcgttgctggacagcatcgatatcgccgatctacgcacgctcgacctggcctctctactgggcctgccaagggtgcgtcctaaccggcgtctgggtcatagcccacgagtgcggccaccacgccttcagcgactac

SEQ ID NO: 8001 - DNA, 350 bp, Artificial
  Mutation in BnaC.FAD2.a introduced by TALE nuclease pair BnFAD2_T01
caggatccatgggtgcaggtggcagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaacgggcctctgggtcatagcccacgagtgcggccaccacgccttcagcgactac

SEQ ID NO: 8002 - DNA, 318 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttggcaggcctctctactgggcctgccaagggtgcgtcctaaccggcgtctgggtcatagcccacgagtgcggccaccacgccttcagcgactac

SEQ ID NO: 8003 - DNA, 277 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacgccttcagcgactac

SEQ ID NO: 8004 - DNA, 339 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaaggctgcgtcctaaccggcgtctgggtcatagcccacgagtgcggccaccacgccttcagcgactac

SEQ ID NO: 8005 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 8006 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaaccggcgtctgggtcatagcccacgagtgcggccaccacgccttcagcgactac

SEQ ID NO: 8007 - DNA, 403 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggatacctgtccgcctttctcccttcgggaagcgtggcgctttctcatagctcaggcctctctactgggcctgccaagggtgcgtcctaacgggcctctgggtcatagcccacgagtgcggccaccacgccttcagcgactac

SEQ ID NO: 8008 - DNA, 379 bp, Artificial
  Mutation in BnaC.FAD2.a introduced by TALE nuclease pair BnFAD2_T01
caggatccatgggtgcaggtggaagaatgcaagtctctcctccttccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctaactgagcctttcgttttatctgttgcttgtcggtggcctctctactgtgcctcccaagggtgcgtcctaactggcgtctgggtcatagcccatgagtgcggccaccacgcctttagcgactac

SEQ ID NO: 8009 - DNA, 340 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccaagggtgcgtcctaaccggcgtctgggtcatagcccacgagtgcggccaccacgccttcagcgactac

SEQ ID NO: 8010 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgtggccaccacgccttcagcgactac

SEQ ID NO: 8011 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctctctactgggcctgccaagggtgcgtcctaaccggcgtctgggtcatagcccacgagggcggccaccacgccttcagcgactac

SEQ ID NO: 8012 - DNA, 349 bp, Artificial
  Mutation in BnaC.FAD2.a introduced by TALE nuclease pair BnFAD2_T01
caggatccatgggtgcaggtggaagaatgcaagtgtatactccctccaagaagtctgaaaccgacaccatcaagcgcgtaccctgcgagacaccgcccttcactgtcggagaactcaagaaagcaatcccaccgcactgtttcaaacgctcgatccatcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcgtccaccacgccttcagcgactac

SEQ ID NO: 8013 - DNA, 341 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccatcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctggcctctctactgggcctgccaagggtgcgtcctaaccggcgtctgggtcatagcccacgagtgcggccaccacgccttcagcaactac

SEQ ID NO: 8014 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgtggcctctctactgggcctgccaagggtgcgtcctaaccggcgtctgggtcatagcccacgagtgcggccaccacgccttcagcgactac

SEQ ID NO: 8015 - DNA, 403 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggatacctgtccgcctttctcccttcgggaagcgtggcgctttctcatagctcaggcctctctactgggcctgccaagggtgcgtcctaaccggcgtctgggtcatagcccacgagtgcggccaccacgccttcagcgactac

SEQ ID NO: 8016 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctacgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 8017 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccccctcctcccccaccctctcccttaccctctactgggcctgccaaggctgcgtcctaacgggcctcttggtcatcgcccacgaatgcggccaccacgccttcagcgactac

SEQ ID NO: 8018 - DNA, 339 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctctctactgggcctgccaagggtgcgtcctaaccggcgtctgggtcatagcccacgagtgcggccaccacgccttcagcgactac

SEQ ID NO: 8019 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctatcctccctcaccctctctcctacttcgcctttggcctctctactgggcctgccaagggtgcgtcctaaccggcgtctgggtcatagcccacgagtgcggccaccacgccttcagcgactac

SEQ ID NO: 8020 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctccttccccgcctggcctctctactgggcctgccaaggctgcgtcctaacgggcctctgggtcatagcccacgagtgcggccaccacgccttcagcgactac

SEQ ID NO: 8021 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 8022 - DNA, 338 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactactgggcctgccaagggtgcgtcctaaccggcgtctgggtcatagcccaccagtgcggccaccacgccttcagcgactac

SEQ ID NO: 8023 - DNA, 321 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaaccggcgtctgggtcatagcccacgagtgcggccaccacgccttcagcgactac

SEQ ID NO: 8024 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgcctgcagcgactac

SEQ ID NO: 8025 - DNA, 345 bp, Artificial
  Mutation in BnaC.FAD2.a introduced by TALE nuclease pair BnFAD2_T01
aggatccatgggggcaggtggaagaatgcaagtgtctcctccctctaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcctctctactgggcctgccaaggctgcgtcctcacgggcctctgggtcatagcccacgagtgcggccaccacgccttcagcgactac

SEQ ID NO: 8026 - DNA, 428 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgggaccgtctccagcgcctgcttgccgccatcgtggctggcgatggccaccacctgctccggggtcaagccgtgggcggcctctctactgggcctgccaagggtgcgtcctaaccggcgtctgggtcatagcccacgagtgcggccaccacgccttcagcgactac

SEQ ID NO: 8027 - DNA, 312 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 8028 - DNA, 354 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccctggcctctctactgggcctgccaagggtgcgtcctcaccggcgtctgggtcatagcccacgagtgcggccaccacgccttcagcgactac

SEQ ID NO: 8029 - DNA, 358 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctaacctggcctctctactgggcctgccaagggtgcgtcctaaccggcgtctgggtcatagcccacgagtgcggccaccacgccttcagcgactac

SEQ ID NO: 8030 - DNA, 345 bp, Artificial
  Mutation in BnaC.FAD2.a introduced by TALE nuclease pair BnFAD2_T01
caggatccatgggtgcatgtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgccttcagcgactac

SEQ ID NO: 8031 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccactagttcgtccaccacgcctagagcgactac

SEQ ID NO: 8032 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtccccaccacttacttccctctcctccctcaccctctctcctacttggcctctctactgggcctgccaaggctgcgtcctaacgggcctctgggtcatcgcccacgaatgcggccaccacgccttcagcgactac

SEQ ID NO: 8033 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaacgggcctctgggtcatcgcccacgaatgcggccaccacgccttcagcgactac

SEQ ID NO: 8034 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaggcctctctactgggcctgccaagggtgcgtcctaaccggcgtctgggtcatagcccacgagtgcggccaccacgccttcagcgactac

SEQ ID NO: 8035 - DNA, 351 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccaagggtgcgtcctaaccggcgtctgggtaatagcccacgagtgcggccaccacgccttcagcgactac

SEQ ID NO: 8036 - DNA, 338 bp, Artificial
  Mutation in BnaC.FAD2.a introduced by TALE nuclease pair BnFAD2_T01
caggatccatgggtgcaggtggcagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcctgccaagggtgcgtcctaaccggcgtctgggtcatagcccacgagtgcggccaccacgccttcagcgactac

SEQ ID NO: 8037 - DNA, 343 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctccagcttctactacgtcgccaccacttacttccctctcctccctcaccctctccccaacctctctactgggcctgccatgggtgcgtcctaaccggcgtctgggtcatagcccacgagtgcggccaccacgccttcagcgactac

SEQ ID NO: 8038 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 8039 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaacgggcctcttggtcatagcccacgagtgcggccaccacgccttcagcgactac

SEQ ID NO: 8040 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgtgacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctacttctggcctctctactgggcctgccaagggtgcgtcctaaccggcgtctgggtcatagcccacgagtgcggccaccacgccttcagcgactac

SEQ ID NO: 8041 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccgacaccatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggtcaccacgccttcagcgactac

SEQ ID NO: 8042 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 8043 - DNA, 390 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcggtggcaagcacctgctggggggtcaagccgtgggcggcctctctactgggcctgccaagggtgcgtcctaaccggcgtctgggtcatagcccacgagtgcggccaccacgccttcagcgactac

SEQ ID NO: 8044 - DNA, 311 bp, Artificial
  Mutation in BnaC.FAD2.a introduced by TALE nuclease pair BnFAD2_T01
caggatccatgggtcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 8045 - DNA, 398 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgccttggcaacgctgcgatcatgtcctgatacttgacagcgacggtccctggcctctctactgggcctgccaagggtgcgtcctaaccggcgtctgggtcatagcccacgagtgcggccaccacgccttcagcgactac

SEQ ID NO: 8046 - DNA, 455 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccgctggcccgcctccagcgcctgcttgccgccatcgtggctggcgatggccaccccctgctccggggtcaagccgtgggcctggcacagcaccggcaacagccgcttggcctctctactgggcctgccaagggtgcgtcctaaccggcgtctgggtcatagcccacgagtgcggccaccacgccttcagcgactac

SEQ ID NO: 8047 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccgacgtctgggtcatagcccacgagtgcggccaccacgccttcagcgactac

SEQ ID NO: 8048 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccaagggtgcgtcctaacgggcctctgggtcatagcccacgagtgcggccaccacgccttcagcgactac

SEQ ID NO: 8049 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 8050 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccctgcttggcctctctactgggcctgccaagggtgcgtcctaaccggcgtctgggtcatagcccacgagtgcggccaccacgccttcagcgactac

SEQ ID NO: 8051 - DNA, 385 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccgtgggcctggcacagcaccggcaacagccgctggaccgtctccagcgcctgcctggcctctctactgggcctgccaagggtgcgtcctaaccggcgtctgggtcatagcccacgagtgcggccaccacgccttcagcgactac

SEQ ID NO: 8052 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaaccggcgtctgggtcatagcccacgagtgcggccaccacgccttcagcgactac

SEQ ID NO: 8053 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactgc

SEQ ID NO: 8054 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcctctctactgggcctgccaagggtgcgtcctaaccggcgtctgggtcatagcccacgagtgcggccaccacgccttcagcgactac

SEQ ID NO: 8055 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtcctaaccggcgtctgggtcatagcccacgagtgcggccaccacgccttcagcgactac

SEQ ID NO: 8056 - DNA, 323 bp, Artificial
  Mutation in BnaC.FAD2.a introduced by TALE nuclease pair BnFAD2_T01
caggatccatgggtgcaggtggaagaatgcaagtctctcctccctccagctcccccggaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaagggtgcgtcctaaccggcgtctgggtcatagcccacgagtgcggccaccacgccttcagcgactac

SEQ ID NO: 8057 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctccttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 8058 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacctcgccaccactttcttccctctcccccctctccctcgcccctactactgggcctgccaagggtgcgtcctaaccggcgtctgggtcatagcccacgagtgcggccaccacgccttcagcgactac

SEQ ID NO: 8059 - DNA, 348 bp, Artificial
  Mutation in BnaC.FAD2.a introduced by TALE nuclease pair BnFAD2_T01
caggatccatgggtgcaggtggcagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctgaccggcgtcgggggcatagcccacgagtgcggccaccacgccttcagcgactac

SEQ ID NO: 8060 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctcggctcctccctctaccacctctccacagcctacttccctctcctccctcaccctctctcctacttggcctctctactgggcctgccaagggtgcgtcctaacgggcctctgggtcatagcccacgagtgcggccaccacgccttcagcgactac

SEQ ID NO: 8061 - DNA, 403 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcttgccgccatcgtggctggcgatggccaccacctgctccggggtcaagccgtgggcctctctacggggcctgccaagggtgcgtcctaaccggcgtctgggtcatagcccacgagtgcggccaccacgccgtcagcgatac

SEQ ID NO: 8062 - DNA, 446 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcagcggtggtttttttgtttgcaagcagcagattacgcgcagaaaaaaaggatctcaggtggtggccatcgccagcaatggcggtggcaagcaggcgctgcctctctactgggcctgccaagggtgcgtcctaaccggcgtctgggtcatagcccacgagtgcggccaccacgtcttcagcgactac

SEQ ID NO: 8063 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagacgcctgaaaccgacaccatcaagcgcgtaccctgcgagacaccgcccttcactatcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccactactgggcctgccaggggtgcgtcctaaccggcgtctgggtcatagcccacgaatgcggccaccacgccttcagcgactac

SEQ ID NO: 8064 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacagcactgtttcaaacgctcgatccctcgctctttctcctacctcatctgggacatcatcatagcctcctgcttctactacgtcgccaccacttacttccctctcctccctcaccctctctcctacttgcctctctactgggcctgccaaggctgcgtcctaacgggcctctgggtcatagcccacgagtgcggccaccacgccttcagcgactac

SEQ ID NO: 8065 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggccgctctactgggcctgccaagggtgcgtcctaaccggcgtctgggtcatagcccacgagtgcggccaccacgccttcagcgactac

SEQ ID NO: 8066 - DNA, 348 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgaatgcggccaccacgccttcagcgactac

SEQ ID NO: 8067 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatggcctctctactgggcctgccaagggtgcgtcctaaccggcgtctgggtcatagcccacgagtgcggccaccacgccttcagcgactac

SEQ ID NO: 8068 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccaaggctgcgtcctaacgggcctctgggtcatcgcccacgaatgcggccaccacgccttcagcgactac

SEQ ID NO: 8069 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattggcctctctactgggcctgccaagggtgcgtcctaaccggcgtctgggtcatagcccacgagtgcggccaccacgccttcagcgactac

SEQ ID NO: 8070 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaagggtgcgtcctaacgggcctctgggtcatagcccacgagtgcggccaccacgccttcagcgactac

SEQ ID NO: 8071 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctccttcggctctctactgggcctgccaagggtgcgtcctaaccggcgtctgggtcatagcccacgagtgcggccaccacgccttcagcgactac

SEQ ID NO: 8072 - DNA, 351 bp, Artificial
  Mutation in BnaC.FAD2.a introduced by TALE nuclease pair BnFAD2_T01
caggatccatgggtgcaggtgccagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcgctggcctctctactgggcctgccaagggtgcgtcctaaccggcgtctgggtcatagcccacgagtgcggccaccacgcctttagcgactac

SEQ ID NO: 8073 - DNA, 343 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaaccggcgtctgggtcatagcccacgagtgcggccaccacgccttcagcgactac

SEQ ID NO: 8074 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctctttctcctacctcatctgggacatcatcatagcctcctgcttctactacgtcgccaccacttacttccatctcctccctcaccctctctcctacgtctggcctctctactgggcctgccaagggtgcgtcctaaccggcgtctgggtcatagcccacgagtgcggccaccacgccttcagcgactac

SEQ ID NO: 8075 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctctttctcctacctcatctgggacatcatcatagcctcctgcttctactacgtcgccaccacttacttccctctcctccctcaccctctctcctaatggcctctctactgggcctgccaagggtgcgtcctaaccggcgtctgggtcatagcccacgagtgcggccaccacgccttcagcgactac

SEQ ID NO: 8076 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccgcttggcctctctactgggcctgccaagggtgcgtcctaaccggcgtctgggtcatagcccacgagtgcggccaccacgccttcagcgactac

SEQ ID NO: 8077 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagactgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctattacgtcgccaccacttacttccctctcctccctcaccctctctcctacttgcctctctacggggcgtgcgaagggtgcgtccttaccggcgtttgggtcatagctggcaagggcgtccacgacgccttgtgggactac

SEQ ID NO: 8078 - DNA, 328 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgccaagggtgcgtcctaaccggcgtctgggtcatagcccacgagtgcggccaccacgccttcagcgacta

SEQ ID NO: 8079 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaagggtgcgtcctaaccggcgtctgggtcatagcccactagtgcggccaccacgccttcagcgactac

SEQ ID NO: 8080 - DNA, 343 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaaccggcgtctgggtcatagcccacgagtgcggccaccacgccttcagcgactac

SEQ ID NO: 8081 - DNA, 349 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 8082 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttggcctctctactgggcctgccaaggctgcgtcctaacgggcctctgggtcatagcccacgagtgcggccaccacgccttcagcgactac

SEQ ID NO: 8083 - DNA, 340 bp, Artificial
  Mutation in BnaC.FAD2.a introduced by TALE nuclease pair BnFAD2_T01
caggatccatgggtgcaggttgaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcacctactctactgggcctgccaagggtgcgtcctaaccggcgtctgggtcattgcccacgagtgcgtccaccacgcctgcagcgactac

SEQ ID NO: 8084 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccgcctctggcctctctactgggcctgccaagggtgcgtcctaaccggcgtctgggtcatagcccacgagtgcggccaccacgccttcagcgactac

SEQ ID NO: 8085 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtcggggtcatagcccacgagtgcggccaccacgccttcagcgactac

SEQ ID NO: 8086 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgtctctctactgggcctgccaagggtgcgtcctaaccggcgtctgggtcatggcccacgagtgcggccaccacgccttcagcgactac

SEQ ID NO: 8087 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccagcagcgactac

SEQ ID NO: 8088 - DNA, 352 bp, Artificial
  Mutation in BnaC.FAD2.a introduced by TALE nuclease pair BnFAD2_T01
caggatccatgggtgcaggtggaagaatgcaagtgtctcctccctccatgaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgctggcctctctactgggcctgccaagggtgcgtcctaaccggcgtctgggtcatagcccacgagtgcggccaccacgccttcagcgactac

SEQ ID NO: 8089 - DNA, 350 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcgtccaccacgccttcagcgactac

SEQ ID NO: 8090 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaacgggcctctgggtcatcgcccacgaatgcggccaccacgccttcagcgactac

SEQ ID NO: 8091 - DNA, 323 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagggtgcgtcctaacgggcctctgggtcatagcccacgagtgcggccaccacgccttcagcgactac

SEQ ID NO: 8092 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 8093 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaaccggcgtctgggtcatagcccacgagtgcggccaccacgccttcagcgactac

SEQ ID NO: 8094 - DNA, 344 bp, Artificial
  Mutation in BnaC.FAD2.a introduced by TALE nuclease pair BnFAD2_T01
caggatccatgggtgcaggtcgaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaagggttcgtcctaaccggcgtctgggtcatagcccacgagtgcggccaccacgccttcagcgactac

SEQ ID NO: 8095 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattggcctctctactgggcctgccaagggtgcgtcctaaccggcgtctgggtcatagcccacgagtgcgtccaccacgccttcagcgactac

SEQ ID NO: 8096 - DNA, 342 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctactctctactgggcctgccaagggtgcgtcctaaccggcgtctgggtcatagcccacgagtgcggccaccacgccttcagcgactac

SEQ ID NO: 8097 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttcctctctactgggcctgccaagggtgcgtcctaaccggcgtctgggtcatagcccacgagtgcggccacaacgccttcagcgactac

SEQ ID NO: 8098 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctaggcctctctactgggcctgccaagggtgcgtcctaaccggcgtctgggtcatagcccacgagtgcggccaccacgccttcagcgactac

SEQ ID NO: 8099 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaaccggcgtctgggtcatagcccacgagtgcggccaccacgccttcagcgactac

SEQ ID NO: 8100 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaaggctgcgtcctaacgggcctctgggtcatcgcccacgaatgcggccaccacgccttcagcgactac

SEQ ID NO: 8101 - DNA, 358 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcgggtctggcccctctactgggcctgccaaggctgcgtcctaacgggcctctgggtcatcgcccacgaatgcggccaccacgccttcagcgactac

SEQ ID NO: 8102 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcggcctctctactgggcctgccaagggtgcgtcctaacgggcctctgggtcatcgcccacgaatgcggccaccacgccttcagcgactac

SEQ ID NO: 8103 - DNA, 342 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctctctactgggcctgccaagggtgcgtcctaacgggcctctgggtcatagcccacgagtgcggccaccacgccttcagcgactac

SEQ ID NO: 8104 - DNA, 390 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcgatggccaccacctgctggggggtcaagccgtgggcggcctctctactgggcctgccaagggtgcgtcctaaccggcgtctgggtcatagcccacgagtgcggccaccacgccttcagcgactac

SEQ ID NO: 8105 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctactgggcctgccaagggtgcgtcctaaccggcgtctgggtcatagcccacgagtgcggccaccacgccttcagcgactac

SEQ ID NO: 8106 - DNA, 350 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttctggcctctctactgggcctgccaagggtgcgtcctaaccggcgtctgggtcatagcccacgagtgcggccaccacgccttcagcgactac

SEQ ID NO: 8107 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccactttcttccctctcctccctcaccctctctcctgcctctctactgggcctgccaagggtgcgtcctaaccggcgtctgggtcatagcccacgagtgcggccaccacgccttcagcgactac

SEQ ID NO: 8108 - DNA, 346 bp, Artificial
  Mutation in BnaC.FAD2.a introduced by TALE nuclease pair BnFAD2_T01
gatccatgggtgcaggtggaagaatgtaagtctctcctccctccagctcccccgaaaccaaaaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtcctaacgggcctctgggtcatagcccacgagtgcggccaccacgccttcagcgactac

SEQ ID NO: 8109 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttaccttggcccctctactgggcctgccaaggctgcgtcctaacgggcctctgggtcatcgcccacgaatgcggccaccacgctttcagcgactac

SEQ ID NO: 8110 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctttactgggcctgccaaggctgcgtcctaaccggcgtctgggtcatagcccacgagtgcggccaccacgccttcagcgactac

SEQ ID NO: 8111 - DNA, 345 bp, Artificial
  Mutation in BnaC.FAD2.a introduced by TALE nuclease pair BnFAD2_T01
caggatccatgggtgcaggtggaagaatgcaagtctatactccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctgaccggcgtctgggtcatagcgcacgagtgcgtccaccacgccttcagcgactac

SEQ ID NO: 8112 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatctctactgggcctgccaagggtgcgtcctaaccggcggcggggtcatagcgcacgagggcggccaccacgcctgcagcgactac

SEQ ID NO: 8113 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgatacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcgggcctctctactgggcctgccaagggtgcgtcctaacgggcctctgggtcatagcccacgagtgcggccaccacgccttcagcgactac

SEQ ID NO: 8114 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactccgcccgcctggcctctctactgggcctgccaagggtgcgtcctaaccggcgtctgggtcatagcccacgagtgcggccaccacgccttcagcgactac

SEQ ID NO: 8115 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgctgccaagggtgcgtcctaaccggcgtctgggtcatagcccacgagtgcggccaccacgccttcagcgactac

SEQ ID NO: 8116 - DNA, 341 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctggcctctctactgggcctgccaagggtgcgtcctaaccggcgtctgggtcatagcccacgagtgcggccaccacgcctgcagcgactac

SEQ ID NO: 8117 - DNA, 349 bp, Artificial
  Mutation in BnaC.FAD2.a introduced by TALE nuclease pair BnFAD2_T01
caggatccatgggtgcaggtggcagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 8118 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccaagggtgcgtcctaaccggcgtctgggtcatagcccacgagtgcggccaccacgccttcagcgactac

SEQ ID NO: 8119 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaacggcgtctgggtcatagcccacgagtgcggccaccacgccttcagcgactac

SEQ ID NO: 8120 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcttagcccacgagtgcggccaccacgccttcagcgactac

SEQ ID NO: 8121 - DNA, 351 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccaaggctgcgtcctaacgggcctctgggtcatcgcccacgaaggcggccaccactccttcagcgactac

SEQ ID NO: 8122 - DNA, 329 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccaaggctgcgtcctaacgggcctctgggtcatagcccacgagtgcggccaccacgccttcagcgactac

SEQ ID NO: 8123 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccatggctgcgtcctaaccggcctctgggtcatagcccacgagtgcggccaccacgccttcagcgactac

SEQ ID NO: 8124 - DNA, 344 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctagcctctctactgggcctgccaagggtgcgtcctaaccggcgtctgggtcatagcccacgagtgcggccaccacgccttcagcgactac

SEQ ID NO: 8125 - DNA, 347 bp, Artificial
  Mutation in BnaC.FAD2.a introduced by TALE nuclease pair BnFAD2_T01
caggatccatgggtgcaggtggaagaatgcaagtatctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcgcctctctactgggcctgccaaggctgcgtcctaacgggcctctgggtcatcgcccacgagtgcggccaccacgccttcagcgactac

SEQ ID NO: 8126 - DNA, 323 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagagtgcgtcctaaccggcgtctgggtcatagcccacgagtgcggccaccacgccttcagcgactac

SEQ ID NO: 8127 - DNA, 337 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctctactgggcctgccaagggtgcgtcctaaccggcgtctgggtcatagcccacgagtgcggccaccacgccttcagcgactac

SEQ ID NO: 8128 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactatgtcgccaccacttacttccctctcctccctcaccggtttgcgtattgccggtgcctggcctctctactgggcctgccaagggtgcgtcctaaccggcgtctgggtcatagcccacgagtgcggccaccacgccttcagcgactac

SEQ ID NO: 8129 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctattggcctctctactgggcctgccaagggtgcgtcctaaccggcgtctgggtcatagcccacgagtgcggccaccacgccttcagcgactac

SEQ ID NO: 8130 - DNA, 335 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctccgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggccttccaagggtgcgtcctgaccgtcgtctgggtcatagcccacgagtgcgtccaccacgccttcagcgactac

SEQ ID NO: 8131 - DNA, 356 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 8132 - DNA, 344 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttggcctctctactgggcctgccaagggtgcgtcctaaccggcgtctgggtcatagcccacgagtgcggccaccacgccttcagcgactac

SEQ ID NO: 8133 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 8134 - DNA, 355 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 8135 - DNA, 347 bp, Artificial
  Mutation in BnaC.FAD2.a introduced by TALE nuclease pair BnFAD2_T01
catgatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 8136 - DNA, 347 bp, Artificial
  Mutation in BnaC.FAD2.a introduced by TALE nuclease pair BnFAD2_T01
caggatccatgggtgcaggtggaagaatgcaagtctctcctccctccagctccccaggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 8137 - DNA, 347 bp, Artificial
  Mutation in BnaC.FAD2.a introduced by TALE nuclease pair BnFAD2_T01
caggatccatgggtgcaggttgaagaatgcaagtgtatcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctcctctctactgggcctgccaagggtgcgtcctaaccggcgtctgtgtcatagcccaccagtgcgtccaccacgccttcagccactac

SEQ ID NO: 8138 - DNA, 357 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggtgcctggcctctctactgggcctgccaagggtgcgtcctaaccggcgtctgggtcatagcccacgagtgcggccaccacgccttcagcgactac

SEQ ID NO: 8139 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcaccgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgggcctctctactgggcctgccaagggtgcgtccgaaccggcgtcggggtcatagcccacgagtgcggcgaccacgccttcagcgactac

SEQ ID NO: 8140 - DNA, 347 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttcctctctactgggcctgccaagggtgcgtcctaaccggcgtctgggtcatagcccacgagtgcggccaccacgccttcagcgactac

SEQ ID NO: 8141 - DNA, 378 bp, Artificial
  Mutation in BnaC.FAD2.a introduced by TALE nuclease pair BnFAD2_T01
caggatccatgggtgcaggtgtaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgcctccagcgcctgcttgccgccatcgtggctggcgatggccaccacctgctccggggtcaagccgtgagggctgggtcatagcccacgagtgcggccaccacgccttcagcgactac

SEQ ID NO: 8142 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccgcgagtgcggccaccacgccttcagcgactac

SEQ ID NO: 8143 - DNA, 321 bp, Artificial
  Mutation in BnaC.FAD2.a introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaaccggcgtctgggtcatagcccacgagtgcggccaccacgccttcagcgactac

SEQ ID NO: 8144 - DNA, 440 bp, Artificial
  Mutation in BnaC.FAD2.a introduced by TALE nuclease pair BnFAD2_T01
caggatccatgggtgcaggtggaagaatgcaagtctctcctccctcaagctcccccggaaccaacaccctcaaacgcgtcccctgcgagacaccacccttcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccccagcggctgttgcccccattattgctggcgatggccaccccctgctggggggtcaagccgtgggatcagggcgagataactgggcaacaatgctctccagcgccggcctctctactgggcctgccaaggctgcgtcctaacgggcctctgggtcatcgcccacgaatgcggccaccacgccttcagcgactac

SEQ ID NO: 8145 - DNA, 348 bp, Artificial
  Mutation in BnaC.FAD2.a introduced by TALE nuclease pair BnFAD2_T01
caggatccatgggtgcaggtggcagaatgcaagtctctactccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggcaaccacgcctgcagcgactac

SEQ ID NO: 8146 - DNA, 350 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 8147 - DNA, 341 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctaccacgtcgccaccacttacttccctctcctccctcaccctctctggcctctctactgggcctgccaagggtgcgtcctaaccggcgtctgggtcatagcccacgagtgcggccaccacgccttcagcgactac

SEQ ID NO: 8148 - DNA, 326 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcctcgtctcctcctccctctaccacctctccacagcctacttccctctcctccccctctactgggcctgccaaggctgcgtcctaacgggcctctgggtcatcgcccacgaatgcggccaccacgccttcagcgactac

SEQ ID NO: 8149 - DNA, 401 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgtaaactgccaggcatcaaactaagcagaaggccatccgtccataggctggcctctctactgggcctgccaagggtgcgtcctaaccggcgtctgggtcatagcccacgagtgcggccaccacgccttcagcgactac

SEQ ID NO: 8150 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagcgtgcgtcctaaccggcgtctgggtcatagcccacgagtgcggccaccacgccttcagcgactac

SEQ ID NO: 8151 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatcccacgctctttctcctacctcatctgggacatcatcatagcctcctgcttctactacgtcgccaccacttacttccctcttctccctcaccctctccccttggcctctctactgggcctgccaagggtgcgtcctaaccggcgtctgggtcatagcccacgagtgcggccaccacgccttcagcgactac

SEQ ID NO: 8152 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttacctctctactgggcctgccaagggtgtgtcctaaccggcgtctgggtcatagcccacgagtgcggccaccacgccttcagcgactac

SEQ ID NO: 8153 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgcctgcagcgactac

SEQ ID NO: 8154 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctttggcctctctactgggcctgccaaggctgcgtcctaacgggcctctgggtcatagcccacgagtgcggccaccacgccttcagcgactac

SEQ ID NO: 8155 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaaggctgcgtcctaacgggcctctgggtcatagcccacgagtgcggccaccacgccttcagcgactac

SEQ ID NO: 8156 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagctcacgagtgcggccaccacgccttcagcgactac

SEQ ID NO: 8157 - DNA, 343 bp, Artificial
  Mutation in BnaC.FAD2.a introduced by TALE nuclease pair BnFAD2_T01
caggatccattggtgcaggtggaagaatgcaagtctctcctcactacagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcgtccaccacgccttcagcgactac

SEQ ID NO: 8158 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaaccggcgtctgggtcatagcccacgagtgcggccaccacgccttcagcgactac

SEQ ID NO: 8159 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 8160 - DNA, 347 bp, Artificial
  Mutation in BnaC.FAD2.a introduced by TALE nuclease pair BnFAD2_T01
caggatccatgagtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccatcagcaactac

SEQ ID NO: 8161 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagggcggccaccacgccttcagcgactac

SEQ ID NO: 8162 - DNA, 354 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccgcctggcctctctactgggcctgccaagggtgcgccctaaccggcgtctgggtcatagcccacgagtgcgtccaccacgccttcagcgactac

SEQ ID NO: 8163 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtgccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaaggctgcgtcctaacgggcctctgggtcatcgcccacgaatgcggccaccacgccttcagcgactac

SEQ ID NO: 8164 - DNA, 398 bp, Artificial
  Mutation in BnaC.FAD2.a introduced by TALE nuclease pair BnFAD2_T01
caggatccatgggtgcaggtggaagaatgcaagtgtctcctccctccaagaagtcttaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgccaacttctcaagattgcaaaacgtggcggcgtgaccgcagtggaggcagtgcatgcgcctctctactgggcctgccaagggtgcgtcctaaccggcgtctgggtcatagcccacgagtgcggccaccacgccttcagcgactac

SEQ ID NO: 8165 - DNA, 349 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtcggggtcatagcccacgagtgcggccaccacgccttcagcgactac

SEQ ID NO: 8166 - DNA, 300 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactttttcaaacgctcgatccctcgctctttctcctacctcatctgggacatcatcatagcctcctgcttctactacgtctctctactgggcctgccaagggtgcgtcctaaccggcgtctgggtcatagcccacgagtgcggccaccacgccttcagcgactac

SEQ ID NO: 8167 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagatgtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 8168 - DNA, 419 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcaggcgctgttgccggtgctgtgccaggcccacggcttgaccccccagcaggtggtggccatcgccagatggcctctctactgggcctgccaagggtgcgtcctaaccggcgtctgggtcatagcccacgagtgcggccaccacgccttcagcgactac

SEQ ID NO: 8169 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccctctctactgggcctgccaagggtgcgtcctaaccggcgtctgggtcatagcccacgagtgcggccaccacgccttcagcgactac

SEQ ID NO: 8170 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctatcctccctcaccctctctcctacttctctactgggcctgccaagggtgcgtcctaaccggcgtctgggtcatagcccacgagtgcggccaccacgccttcagcgactac

SEQ ID NO: 8171 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggggtctgggtcatagcccacgagtgcggccacctcgcctgcagcgactac

SEQ ID NO: 8172 - DNA, 401 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctctctcaccctctctcctacttcggtccagcgcctgcttgccaccattattgctggcgatggcccccacccgctgggcctctctactgggcctgccaagggtgcgtcctaaccggcgtctgggtcatagcccacgagtgcggccaccacgccttcagcgactac

SEQ ID NO: 8173 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaggcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctacggggcctgccaagggtgcgtcctaaccggcgtctgggtcatagcccacgagtgcggccaccacgccttcagcgactac

SEQ ID NO: 8174 - DNA, 312 bp, Artificial
  Mutation in BnaC.FAD2.a introduced by TALE nuclease pair BnFAD2_T01
caggatccatgggtgcaggtggaagaatgcaagtgtatcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 8175 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaacgggcctctgggtcatcgcccacgaatgcggccaccacgccttcagcgactac

SEQ ID NO: 8176 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctccctcaccctctctcctactttggcctctctactgggcctgccaagggtgcgtcctaaccggcgtctgggtcatagcccacgagtgcggccaccacgccttcagcgactac

SEQ ID NO: 8177 - DNA, 424 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctcctccagcgcctgcttgccgccatcgtggctggcgatggccaccacctgctccggggtcaagccgtgggcctggcatggcctctctactgggcctgccaagggtgcgtcctaaccggcgtctgggtcatagcccacgagtgcggccaccacgccttcagcgactac

SEQ ID NO: 8178 - DNA, 385 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgattcctcgctctttctcctacctcatctgggacatcatcatagcctcctgcttctactacgtcgccaccacttacttccctctcctccccgtgggcctggcacagcaccggcaccagccgctggaccgtctccagcgcctgcctggcctctctactgggcctgccaagggtgcgtcctaaccggcgtctgggtcatagcccacgagtgcggccaccacgccttcagcgactac

SEQ ID NO: 8179 - DNA, 348 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcgcctctctactggtcctgccaagggtgcgtcctaacgggcctctgggtcatagcccacgagtgcggccaccacgccttcagcaactac

SEQ ID NO: 8180 - DNA, 344 bp, Artificial
  Mutation in BnaC.FAD2.a introduced by TALE nuclease pair BnFAD2_T01
caggatacatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaaggctgcgtcctaacgggcctctgggtcatcgcccacgaatgcggccaccacgccttcagcgactac

SEQ ID NO: 8181 - DNA, 323 bp, Artificial
  Mutation in BnaC.FAD2.a introduced by TALE nuclease pair BnFAD2_T01
caggatccatgggtgcaggtggaagaatgcaagtgcctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagcgtgcgtcctaaccggcgtctgggtcatagcccacgattgcggccaccacgccttcagcgactac

SEQ ID NO: 8182 - DNA, 349 bp, Artificial
  Mutation in BnaC.FAD2.a introduced by TALE nuclease pair BnFAD2_T01
caggatccagggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 8183 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggtgcgtcctaaccggcgtctgggtcatagcccacgagtgcggccaccacgccttcagcgactac

SEQ ID NO: 8184 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctaatgggcctgccaagggtgcgtcctaacgggcctctgggtcatagcccacgagtgcggccaccacgccttcagcgactac

SEQ ID NO: 8185 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccgtcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgggcctctctactgggcctgccaagggtgcgtcctaaccggcgtctgggtcatagcccacgagtgcggccaccacgccttcagcgactac

SEQ ID NO: 8186 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgatacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 8187 - DNA, 345 bp, Artificial
  Mutation in BnaC.FAD2.a introduced by TALE nuclease pair BnFAD2_T01
cagggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 8188 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcctggcctctctactgggcctgccaagggtgcgtcctaaccggcgtctgggtcatagcccacgagtgcggccaccacgccttcagcgactac

SEQ ID NO: 8189 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggctgcgtcctaacgggcctctgggtcatcgcccacgaatgcggccaccacgccttcagcgactac

SEQ ID NO: 8190 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctctctactgggcctgccaagggtgcgtcctaaccggcgtctgggtcatagcccacgagtgcggccaccacgccttcagcgactac

SEQ ID NO: 8191 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatcgcctcctgcttctactacgtcgccaccacttacttccctctcctccctcaccctctccccttggcctctctactgggcctgccaagggtgcgtcctaaccggcgtctgggtcatagcccacgagtgcggccaccacgccttcagcgactac

SEQ ID NO: 8192 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctcctttggcctctctactgggcctgccaagggtgcgtcctaaccggcgtctgggtcatagcccacgagtgcggccaccacgccttcagcgactac

SEQ ID NO: 8193 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcctccctcaccctctctcctaggcctctctactgggcctgccaagggtgcgtcctaaccggcgtctgggtcatagcccacgagtgcggccaccacgccttcagcgactac

SEQ ID NO: 8194 - DNA, 340 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccatggctgcgtcctaaccggcgtctgggtcatagcccacgagtgcggccaccacgccttcagcgactac

SEQ ID NO: 8195 - DNA, 349 bp, Artificial
  Mutation in BnaC.FAD2.a introduced by TALE nuclease pair BnFAD2_T01
gcaggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 8196 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcacaccgcactgtttcaaacgctcgatccctcgctctttctcctacctcatctgggacatcatcatagcctcctgcttctactacgtcgccaccacttacttccctctcctccctcaccctctctcctacttgggcctctctactgggcctgccaagggtgcgtcctaaccggcgtctgggtcatagcccacgagtgcggccaccacgccttcagcgactac

SEQ ID NO: 8197 - DNA, 349 bp, Artificial
  Mutation in BnaC.FAD2.a introduced by TALE nuclease pair BnFAD2_T01
caggatccatgggtgcaggcggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 8198 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctatctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 8199 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgcctgggtcatagcccacgagtgcggccaccacgccttcagcgactac

SEQ ID NO: 8200 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcaagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 8201 - DNA, 348 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 8202 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttggcctctctactgggcctgccaagggtgtgtcctaaccggcgtctgggtcatagcccacgagtgcggccaccacgccttcagcgactac

SEQ ID NO: 8203 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggtggcctctctactgggcctgccaagggtgcgtcctaaccggcgtcttggtcatagcccacgagtgcggccaccacgccttcagcgactac

SEQ ID NO: 8204 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccctcggggcctctctactgggcctgccaagactgcgtcctaacgggcctctgggtcatagcccacgagtgcggccaccacgccttcagcgactac

SEQ ID NO: 8205 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaacgggcctctgggtcatagcccacgagtgcggccaccacgccttcagcgactac

SEQ ID NO: 8206 - DNA, 329 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgccaagggtgcgtcctaacgggcctctgggtcatagcccacgagtgcggccaccacgccttcagcgactac

SEQ ID NO: 8207 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgctgccaccacgccttcagcgactac

SEQ ID NO: 8208 - DNA, 352 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtccactgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccaagggtgcgtcctaaccggcgtctgggtcatagcccacgagtgcggccaccacgccttcagcgactac

SEQ ID NO: 8209 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaaggctgcgtcctaacgggcctctgggtcatcgcccacgaatgcggccaccacgccttcagcgactac

SEQ ID NO: 8210 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttggcctctctactgggcctgccaagggtgcgtcctaaccggcgtctgggtcatagcccacgagtgcggccaccacgccttcagcgactac

SEQ ID NO: 8211 - DNA, 405 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcaatgcactgacgggtgccccgctcaacttgaccccccagcaggtggtggccatcggcctctctactgggcctgccaagggtgcgtcctaaccggcctctgggtcatcgcccacgaatgcggccaccacgccttcagcgactac

SEQ ID NO: 8212 - DNA, 343 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagcgtgcgtcctaaccggcgtctgggtcatatcccacgagtgcggccaccacgccttcagcgactac

SEQ ID NO: 8213 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttccctggcccctctactgggcctgccaaggctgcgtcctaacgggcctctgggtcatcgcccacgaatgcggccaccacgccttcagcgactac

SEQ ID NO: 8214 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 8215 - DNA, 419 bp, Artificial
  Mutation in BnaC.FAD2.a introduced by TALE nuclease pair BnFAD2_T01
caggatccatgggtgcaggtggaagaatgcaagtctctcctccctccagctcccccggaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactaagactgggcctttcgttttatctgttgtttgtcggtgaacgctctcctgagtaggacaaatccgctcccttggcttttttactgggcctgccaagggtgcgtcctaaccggcgtctgggtcatagcccacgagtgcggccaccacgccttcagcgactac

SEQ ID NO: 8216 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccaagggtgcgtcctaacctgcgtctgggtcatagcccacgagtgcggccaccacgccttcagcgactac

SEQ ID NO: 8217 - DNA, 312 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 8218 - DNA, 351 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcctctctactgggcctgccaagggtgcgtcctaaccggcgtctgggtcatagcccacgagtgcggccaccacgccttcagcgactac

SEQ ID NO: 8219 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatcgcccacgaatgcggccaccacgccttcagcgactac

SEQ ID NO: 8220 - DNA, 324 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcttgccaagggtgcgtcctaaccggcgtctgggtcatagcccacgagtgcggccaccacgccttcagcgactac

SEQ ID NO: 8221 - DNA, 335 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccatcgctctttctcctacctcatctgggacatcatcatagcctcctgcttctactacgtcgccaccacttacttccctctcctccctcaccctctctcctactgggcctgccaagggtgcgtcctaaccggcgtctgggtcatagcccacgagtgcggccaccacgccttcagcgactac

SEQ ID NO: 8222 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 8223 - DNA, 390 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcgatggccaccccctgctggggggtcaagccgtgggcggcctctctactgggcctgccaagggtgcgtcctaaccggcgtctgggtcatagcccacgagtgcggccaccacgccttcagcgactac

SEQ ID NO: 8224 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcgaccaccacgccttcagcgactac

SEQ ID NO: 8225 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaacgggcctctgggtcatagcccacgagtgcggccaccacgccttcagcgactac

SEQ ID NO: 8226 - DNA, 324 bp, Artificial
  Mutation in BnaC.FAD2.a introduced by TALE nuclease pair BnFAD2_T01
caggatccatgggtgcaggtcgaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcgccaagggtgcgtcctaaccggcgtctgggtcatagcccacgagtgcggccaccacgccttcagcgactac

SEQ ID NO: 8227 - DNA, 342 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaagggtgcgtcctaaccggcgtctgggtcatagcccacgagtgcggccaccacgccttcagcgactac

SEQ ID NO: 8228 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtctctctactgggcctgccaaggctgcgtcctaacgggcctctgggtcatagcccacgagtgcggccaccacgccttcagcgactac

SEQ ID NO: 8229 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttgcctctctactgggcctgccaagggtgcgtcctaaccggcgtctgggtcatagcccacgagtgcggccaccacgccttcagcgactac

SEQ ID NO: 8230 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctggcctctctactgggcctgccaagggtgcgtcctaaccggcgtctgggtcatagcccacgagtgcggccaccacgccttcagcgactac

SEQ ID NO: 8231 - DNA, 355 bp, Artificial
  Mutation in BnaC.FAD2.a introduced by TALE nuclease pair BnFAD2_T01
cgggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccaagggtgcgtcctaaccggcgtctgggtcatagcccacgagtgcggccaccacgccttcagcgactac

SEQ ID NO: 8232 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaagggtgcgtcctaaccggcgtctgggtcatagcccacgagtgcggccaccacgccttcagggactac

SEQ ID NO: 8233 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgcaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 8234 - DNA, 345 bp, Artificial
  Mutation in BnaC.FAD2.a introduced by TALE nuclease pair BnFAD2_T01
caggatccatgggtgcaggcggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgccttcagcgactac

SEQ ID NO: 8235 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 8236 - DNA, 390 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcggtggcaagcacctgctggggggtcaagccgtgggcggcctctctactgggcctgccaagggtgcgtcctaaccggcgtctgggtcatagcccacgagtgcggccaccacgccttcagcgactac

SEQ ID NO: 8237 - DNA, 349 bp, Artificial
  Mutation in BnaC.FAD2.a introduced by TALE nuclease pair BnFAD2_T01
caggatccatgggtgcaggtggaagaatgtaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 8238 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcaacgactac

SEQ ID NO: 8239 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctctgggacatcatcatagcctcctgcttctactacgtcgccaccacttacttccctctcctccctcaccctctctcctactttcctctctactgggcctgccaagggtgcgtcctaaccggcgtctgggtcatagcccacgagtgcggccaccacgccttcagcgactac

SEQ ID NO: 8240 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcctccctcaccctctctcctaggcctctctactgggcctgccaaggctgcgtcctaacgggcctctgggtcatagcccacgagtgcggccaccacgccttcagcgactac

SEQ ID NO: 8241 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctcccctggcctctctactgggcctgccaagggtgcgtcctaaccggcgtctgggtcatagcccacgagtgcggccaccacgccttcagcgactac

SEQ ID NO: 8242 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccaagggtgcgtcctaaccggcgtctgggtcatcgcccacgaatgcggccaccacgccttcagcgactac

SEQ ID NO: 8243 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccggcctctctactgggcctgccaagggtgcgtcctaaccggcgtctgggtcatagcccacgagtgcggccaccacgccttcagcgactac

SEQ ID NO: 8244 - DNA, 346 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 8245 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgatac

SEQ ID NO: 8246 - DNA, 347 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattggcctctctactgggcctgccaagggtgcgtcctaaccggcgtctgggtcatagcccacgagtgcggccaccacgccttcagcgactac

SEQ ID NO: 8247 - DNA, 323 bp, Artificial
  Mutation in BnaC.FAD2.a introduced by TALE nuclease pair BnFAD2_T01
caggatccatgggtgtaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctaagggtgcgtcctaaccggcgtctgggtcatagcccacgagtgcggccaccacgccttcagcgactac

SEQ ID NO: 8248 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccaacttggcctctctactgggcctgccaagggtgcgtcctaaccggcgtctgggtcatagcccacgagtgcggccaccacgccttcagcgactac

SEQ ID NO: 8249 - DNA, 343 bp, Artificial
  Mutation in BnaC.FAD2.a introduced by TALE nuclease pair BnFAD2_T01
caggatccatgggtgcaggtggaagaatgcaagtctctcctccatccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcgcacgagtgcggccaccacgccttcatcgactac

SEQ ID NO: 8250 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctctactgggcctgccaagggtgcgtcctaaccggcgtctgggtcatagcccacgagtgcggccaccacgccttcagcgactac

SEQ ID NO: 8251 - DNA, 349 bp, Artificial
  Mutation in BnaC.FAD2.a introduced by TALE nuclease pair BnFAD2_T01
caggatccatgggtgcaggtgcaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 8252 - DNA, 348 bp, Artificial
  Mutation in BnaC.FAD2.a introduced by TALE nuclease pair BnFAD2_T01
caggatccatgggttcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttggcctctctactgggcctgccaagggtgcgtcctaaccggcgtctgggtcatagcccacgagtgcggccaccacgccatcagcgactac

SEQ ID NO: 8253 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggtctgccaagggtgcgtcctaaccggcgtctgggtcatagcccacgagtgcggccaccacgccttcagcgactac

SEQ ID NO: 8254 - DNA, 347 bp, Artificial
  Mutation in BnaC.FAD2.a introduced by TALE nuclease pair BnFAD2_T01
caggatccatgggtgcaggtggaagaatgcaagtgtctcctccctcccagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctcctctctactgggcctgccaagggtgcgtcctaaccggcgtctgggtcatagcccacgagtgcggccaccacgccttcagcgactac

SEQ ID NO: 8255 - DNA, 348 bp, Artificial
  Mutation in BnaC.FAD2.a introduced by TALE nuclease pair BnFAD2_T01
caggatccatgggtgcaggtggaagaatgcaagtgactcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcccctgcttctactacgtcgccaccacttacttccctctcctccctcaccctctctcctacgtgagccgctctactgggccagccaagggtgcgtccgaacgggcgtcggggtcatatcccacgagtgcggccaccacaccttcagcagctac

SEQ ID NO: 8256 - DNA, 277 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaacaccctcaaacgcgtcccctgcgagacaccaccattcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcacgccttcagcgactac

SEQ ID NO: 8257 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctcttctcctacctcatctgggacatcatcatagcctcctgcttctactacgtcgccaccacttacttccctctcctccctcaccctctctcctactttggcctctctactgggcctgccaaggctgcgtcctaaccggcgtctgggtcatagcccacgagtgcggccaccacgccttcagcgactac

SEQ ID NO: 8258 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgtcctaacgggcctctgggtcatagcccacgagtgcggccaccacgccttcagcgactac

SEQ ID NO: 8259 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttctctactgggcctgccaagggtgcgtcctaaccggcgtctgggtcatagcccacgagtgcggccaccacgccttcagcgactac

SEQ ID NO: 8260 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccgccgcactgtttcaaacgctcgatccctcgctctttctcctacctcatctgggacatcatcatagcctcctgcttctactacgtcgccaccacttacttccctctcctccctcaccctctctcctacctcggcctctctactgggcctgccaagggtgcgtcctaaccggcgtctgggtcatagcccacgagtgcggccaccacgccttcagcgactac

SEQ ID NO: 8261 - DNA, 348 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 8262 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttcctggcctctctactgtgcctgccaagggtgcgtcctaaccggcgtctgggtcatagcccacgagtgcggccaccacgccttcagcgactac

SEQ ID NO: 8263 - DNA, 344 bp, Artificial
  Mutation in BnaC.FAD2.a introduced by TALE nuclease pair BnFAD2_T01
caggatccatgggtgcaggtggaagaatgcgagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcttggcctctctactgggcctgccaagggtgcgtcctaaccggcgtctgggtcatagcccacgagtgcggccaccacgccttcagcgactac

SEQ ID NO: 8264 - DNA, 351 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactccagaaagcaatcccaccacactgtttcaaacgctcgatccctcgctctttctcctcccgcatctgggacatcatcatagcctcctgcttctactacgtcgccaccacttacttccctctcctccctcaccctctctccaacttgctggcagctctacgaggcctgacaagggtgctgcctaaccggcgtctgggtcatagcccacgagtgaggccaccacgccatcagcgactac

SEQ ID NO: 8265 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctggcctctctactgggcctgccaagggtgcgtcctaaccggcgtctgggtcatagcccacgagtgcggccaccacgccttcagcgactac

SEQ ID NO: 8266 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccgcctctctactgggcctgccaagggtgcgtcctaaccggcgtctgggtcatagcccacgagtgcggccaccacgccttcagcgactac

SEQ ID NO: 8267 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctgctacgtcgccaccacttacttccctctcctccctcaccctctctcctacttcgcctttggcctctctactgggcctgccaagggtgcgtcctaaccggcgtctgggtcatagcccacgagtgcggccaccacgccttcagcgactac

SEQ ID NO: 8268 - DNA, 325 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggctgcgtcctaaccagcgtctgggtcatagcccacgagtgcggccaccacgccttcagcgactac

SEQ ID NO: 8269 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatccaaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 8270 - DNA, 344 bp, Artificial
  Mutation in BnaC.FAD2.a introduced by TALE nuclease pair BnFAD2_T01
caggatccatgggtgcaggtggaagaatgcaagtgtcacctacctccaagaagactgaaaacgacaccatcaagcgcgtaccctgcgagacactgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgtgtcatagcccacgagtgcggccaccacgccttcaacgactac

SEQ ID NO: 8271 - DNA, 350 bp, Artificial
  Mutation in BnaC.FAD2.a introduced by TALE nuclease pair BnFAD2_T01
caggatccatgggtgcaggtggaagaatgcaagtggctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgttagcctctctactgggcctgccaagggtgcgtcctaaccggcgtctgggtcatagcccacgagtgcggccaccacgccttcagcgactac

SEQ ID NO: 8272 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcccctctactgggcctgccaaggctgcgtcctaacgggcctctgggtcatagcccacgagtgcggccaccacgccttcagcgactac

SEQ ID NO: 8273 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 8274 - DNA, 334 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactaaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccacgagtgcggccaccacgccttcagcgactac

SEQ ID NO: 8275 - DNA, 349 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggcctgccaagggtgcgtcctaaccggcgtctgggtcatagcccacgagtgcggccaccacgccttcagcgactac

SEQ ID NO: 8276 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 8277 - DNA, 347 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctggcctctctactgggcctgccaagggtgcgtcctaaccggcgtctgggtcatagcccacgagtgcggccaccacgccttcagcgactac

SEQ ID NO: 8278 - DNA, 365 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccacctcactgcttcaaacgctccatcccacgctccttctcctcttcgacatcatcatctcctcctcggctcctccctcaccctctctcctacttcggtccagcgcctgcttgccaccattattgctggcgatggccaccacctgctgggcctctctactgggcctgccaagggtgcgtcctaaccggcgtctgggtcatagcccacgagtgcggccaccacgccttcagcgactac

SEQ ID NO: 8279 - DNA, 348 bp, Artificial
  Mutation in BnaC.FAD2.a introduced by TALE nuclease pair BnFAD2_T01
caggatccatgggtgcaggtggaataatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 8280 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcgccctctctcctactggcctctctactgggcctgccaagggtgcgtcctaaccggcgtctgggtcatagcccacgagtgcggccaccacgccttcagcgactac

SEQ ID NO: 8281 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccttaccctctctcctacttcgccgcctggcctctctactgggcctgccaagggtgcgtcctaaccggcgtctgggtcatagcccacgagtgcggccaccacgccttcagcgactac

SEQ ID NO: 8282 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccttggcctctctactgggcctgccaagggtgcgtcctaaccggcgtctgggtcatagcccacgagtgcggccaccacgccttcagcgactac

SEQ ID NO: 8283 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaacgggcctctgggtcatcgcccacgaatgcggccaccacgccttcagcgactac

SEQ ID NO: 8284 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctggcctctctactgggcctgccaagggtgcgtcctaaccggcgtctgggtcatagcccacgagtgcggccaccacgccttcagcgactac

SEQ ID NO: 8285 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcgctgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccaagggtgcgtcctaaccggcgtctgggtcatagcccacgagtgcggccaccacgccttcagcgactac

SEQ ID NO: 8286 - DNA, 350 bp, Artificial
  Mutation in BnaC.FAD2.a introduced by TALE nuclease pair BnFAD2_T01
caggatccatgggttcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaaggctgcgtcctaacgggcctctgggtcatagcccacgagtgcggccaccacgccttcagcgactac

SEQ ID NO: 8287 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccactagtgcggccaccacgccttcagcgactac

SEQ ID NO: 8288 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcggggcctctctactgggcctgccaagggtgcgtcctaaccggcgtctgggtcatagcccacgagtgcggccaccacgccttcagcgactac

SEQ ID NO: 8289 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatggcctctctactgggcctgccaagggtgcgtcctaaccggcgtctgggtcatagcccacgagtgcggccaccacgccttcagcgactac

SEQ ID NO: 8290 - DNA, 346 bp, Artificial
  Mutation in BnaC.FAD2.a introduced by TALE nuclease pair BnFAD2_T01
caggatccatgggtgcaggtggaagaatgtaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgctac

SEQ ID NO: 8291 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcgaacgctcgatccctcgctctttctcctacctcatctgggacatcatcatagcctcctgcttctactacgtcgccaccacttacttccctctcctccctcaccctctcacctacattggcctctctactgggcctgccaagggtgcgtcctaaccggcgtcagggtcatagcccacgagtgcggccaccaagccatcagcgactac

SEQ ID NO: 8292 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 8293 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 8294 - DNA, 346 bp, Artificial
  Mutation in BnaC.FAD2.a introduced by TALE nuclease pair BnFAD2_T01
aaggatccatgggtcaggtagaagaatgcaagtctctcctccctccagctcccccggaaccaacaccctcaaacgcgtcccctgcgagacaccaccattcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtactaaccggcgtctgggtcatagcccacgagtgcggccaccacgccttcagcgactac

SEQ ID NO: 8295 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttactgggcctgccaaggctgcgtcctaacgggcctctgggtcatcgcccacgaatgcggccaccacgccttcagcgactac

SEQ ID NO: 8296 - DNA, 404 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcttgccgccatcgtggctggcgatggccaccacctgctccggggtcaagccgtgggcctctctactgggcctgccaagggtgcgtcctaaccggcgtctgggtcatagcccacgagtgcggccaccacgccttcagcgactac

SEQ ID NO: 8297 - DNA, 345 bp, Artificial
  Mutation in BnaC.FAD2.a introduced by TALE nuclease pair BnFAD2_T01
caggatccatgggtgcaggtcgaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtcggggtcatagcccacgagtgcggccaccacgccttcagcgactac

SEQ ID NO: 8298 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 8299 - DNA, 395 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccatctctcctacttcgccgcaaactcttcctggctagcggtacgcgtattaattgcgtcctggcctctctactgggcctgccaagggtgcgtcctaaccggcgtctgggtcatagcccacgagtgcggccaccacgccttcagcgactac

SEQ ID NO: 8300 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttggcctctctactgggcctgccaagggtgcgtcctaaccggcgtctgggtcatagcccacgagtgcggccaccacgccttcagcgactaccgactac

SEQ ID NO: 8301 - DNA, 347 bp, Artificial
  Mutation in BnaC.FAD2.a introduced by TALE nuclease pair BnFAD2_T01
caggatccatgggtgcaggtagaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcttcctaaccggcgtctgggtcatagcccacgagtgcggccaccacgccttcagcgactac

SEQ ID NO: 8302 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctagcctcccttggcctctctactgggcctgccaagggtgcgtcctaaccggcgtctgggtcatagcccacgagtgcggccaccacgccttcagcgactac

SEQ ID NO: 8303 - DNA, 429 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctctccagcggctgttgccggttctttgccaggcccccggcttgaccccggagcaggtggtggccatcgccacccacgatggtggcccctctactgggcctgccaaggctgcgtcctaacgggcctctgggtcatcgcccacgaatgcggccaccacgccttcagcgactac

SEQ ID NO: 8304 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaggggtgcgtcctaacgggcctctgggtcatagcccacgaatgcggccaccactccttcagcgactac

SEQ ID NO: 8305 - DNA, 318 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttggcaggcctctctactgggcctgccaagggtgcgtcctaaccggcgtctgggtcatagcgcacgagtgcggccaccacgccttcagcgactac

SEQ ID NO: 8306 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaaggctgcgtcctaacgggcctctgggtcatcgcccacgaatgcggccaccacgccttcagcgactac

SEQ ID NO: 8307 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttctggcctctctactgggcctgccaaggctgcgtcctaaccggcgtctgggtcatagcccacgagtgcggccaccacgccttcagcgactac

SEQ ID NO: 8308 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctccccttcggctctctactgggcctgccaaggctgcgtcctaacgggcctctgggtcatagcccacgagtgcggccaccacgccttcagcgactac

SEQ ID NO: 8309 - DNA, 358 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctcgcctgacctctctactgggcctgccaagggtgcgtcctaacgggcctctgggtcatagcccacgagtgcggccaccacgccttcagcgactac

SEQ ID NO: 8310 - DNA, 358 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccacccttcactgtcggagaactcaagaaagcaatcccaccgcactgtttcaaacgctcgatccctcgctctttctcctacctcatctgggccatcatcatagcctcctgcttctactccgtcgcccccacttacttccctctcctccctccccctctcccctacctctcctcgcctggcctctctactgggcctgccaagggtgcgtcctaaccggcgtctgggtcatagcccacgagtgcggccaccacgccttcagcgactac

SEQ ID NO: 8311 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctctctactgggcctgccaaggctgcgtcctaacgggcctctgggtcatcgcccacgaatgcggccaccacgccttcagcgacac

SEQ ID NO: 8312 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgaatgcggccaccacgccttcagcgactac

SEQ ID NO: 8313 - DNA, 329 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactgccaagggtgcgtcctaaccggcgtctgggtcatagcccacgagtgcggccaccacgccttcagcgactac

SEQ ID NO: 8314 - DNA, 374 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccaggcttatcttggacaagaagaagatcgctctctactgggcctgccaagggtgcgtcctaaccggcgtctgggtcatagcccacgagtgcggccaccacgccttcagcgactac

SEQ ID NO: 8315 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtactctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 8316 - DNA, 340 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccaaggctgcgtcctaacgggcctctgggtcatagcccacgagtgcggccaccacgccttcagcgactac

SEQ ID NO: 8317 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaacgggcctctgggtcatcgcccacgaatgcggccaccacgccttcagcgactac

SEQ ID NO: 8318 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaacgggcctctgggtcatagcccacgagtgcggccaccacgccttcagcgactac

SEQ ID NO: 8319 - DNA, 344 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaagggtgcgtcctaaccggcgtctgggtcatagcccacgagtgcggccaccacgccttcagcgactac

SEQ ID NO: 8320 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctccctcaccctctctcctacttcgcctctctactgggcctgccaagggtgcgtcctaactggcctctgggtcatcgcccacgaatgcggccaccacgccttcagcgactac

SEQ ID NO: 8321 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgtggccaccacgccttcagcgactac

SEQ ID NO: 8322 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccgcctctctactgggcctgccaagggtgcgtcctaaccggcgtctgggtcatagcccacgagtgcggccaccacgccttcagcgactac

SEQ ID NO: 8323 - DNA, 343 bp, Artificial
  Mutation in BnaC.FAD2.a introduced by TALE nuclease pair BnFAD2_T01
caggatccatgggtacaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 8324 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactgc

SEQ ID NO: 8325 - DNA, 358 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctcacctggcctctctactgggcctgccaagggtgcgtcctaaccggcgtctgggtcatagcccacgagtgcggccaccacgccttcagcgactac

SEQ ID NO: 8326 - DNA, 339 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggcctgccaagggtgcgtcctaaccggcgtctgggtcatagcccacgagtgcggccaccacgccttcagcgactac

SEQ ID NO: 8327 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagtagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattggcctctctactgggcctgccaagggtgcgtcctaaccggcgtctgggtcatagcccacgagtgcggccaccacgccttcagcgactac

SEQ ID NO: 8328 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggtcatcatcatagcctcctgcttctactacgtcgccaccacttacttccctctcctccctcaccctctctcctacttggcctctctactgggcctgccaaggctgcgtcctaacgggcctctgggtcatagcccacgagtgcggccaccacgccttcagcgactac

SEQ ID NO: 8329 - DNA, 323 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttatcctacctcatctgggacatcatcatagcctcctgcttctactacgtcgccaccacttacttccctcgagccacccactgggcctgccaagggtgcgtcctaaccggcgtctgggtcatcgcccacgaatgcggccaccacgccttcagcgactac

SEQ ID NO: 8330 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccttcggctctctactgggcctgccaagggtgcgtcctaaccggcgtctgggtcatagcccacgagtgcggccaccacgccttcagcgactac

SEQ ID NO: 8331 - DNA, 349 bp, Artificial
  Mutation in BnaC.FAD2.a introduced by TALE nuclease pair BnFAD2_T01
gaggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgaatgcggccaccacgccttcagcgactac

SEQ ID NO: 8332 - DNA, 418 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttagccgtagttaggccaccacttcaagaactctgtagcaccgcctacatacctcgctctgctaatcctgttacctggcccctctactgggcctgccaaggctgcgtcctaacgggcctctgggtcatcgcccacgaatgcggccaccacgccttcagcgactac

SEQ ID NO: 8333 - DNA, 433 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttaaagtcgcctaaggtcactatcagctagcaaatatttcttgtcaaattgatgagcaatgcttttttataatgccaactttcgcctggcctctctactgggcctgccaagggtgcgtcctaaccggcgtctgggtcatagcccacgagtgcggccaccacgccttcagcgactac

SEQ ID NO: 8334 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcctctgggtcatagcccacgagtgcggccaccacgccttcagcgactac

SEQ ID NO: 8335 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacccttggcctctctactgggcctgccaagggtgcgtcctaaccggcgtctgggtcatagcccacgagtgcggccaccacgccttcagcgactac

SEQ ID NO: 8336 - DNA, 403 bp, Artificial
  Mutation in BnaC.FAD2.a introduced by TALE nuclease pair BnFAD2_T01
caggatccatgggtgcaggtggaagaatgctagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggatccctgtccgcctttctcccttcgggaagcgtggcgctttctcatagctcaggcctctctacagggcctgccaagggtgcgtcctaaccggcgtctgggtcatagcccgcgagtgcggccaccacgccttcagcgactac

SEQ ID NO: 8337 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctcccccaccctctctcctaggcctctctactgggcctgccaagggtgcgtcctaaccggcgtctgggtcatagcccacgagtgcggccaccacgccttcagcgactac

SEQ ID NO: 8338 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 8339 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaaggaagcaatcccaccgcactgtttcaaacgctcgatccctcgctctttctcctacctcatctgggacatcatcatagcctcctgcttctactacgtcgccaccacttacttccctctcctccctcaccctctctctgtctctctactgggcctgccaagggtgcgtcctaaccggcgtctgggtcatagcccacgagtgcggccaccacgccttcagcgactac

SEQ ID NO: 8340 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccgcctggcctctctactgggcctgccaagggtgcgtcctaaccggcgtctgggtcatagcccacgagtgcggccaccacgcattcagcgactac

SEQ ID NO: 8341 - DNA, 349 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactcggcctgccaagggtgcgtcctaaccggcgtcggggtcatagcccacgagtccggccaccacgccttcagcgactac

SEQ ID NO: 8342 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccccttacttccctctcctccctcaccctctctcctactacgccggcccctctactgggcctgccaatgctgcgtcctaccgggcctctgggtcatcgcccacgaatgcggccaccacgccttcagcgactac

SEQ ID NO: 8343 - DNA, 405 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccacttcgcaatgcactgacgggtgccccgctcaacttgcccccccagcaggtggtggccagcggcctctctactgggcctgccaaggctgcgtcctaacgggcctctgggtcatagcccacgagtgcggccaccacgccttcagcgactac

SEQ ID NO: 8344 - DNA, 341 bp, Artificial
  Mutation in BnaC.FAD2.a introduced by TALE nuclease pair BnFAD2_T01
cagggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 8345 - DNA, 408 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgagccgaagtttccaaaaggtcgttgatcaaagctcgccgcgttgtttcatcaagccttggcctctctactgggcctgccaagggtgcgtcctaaccggcgtctgggtcatagcccacgagtgcggccaccacgccttcagcgactac

SEQ ID NO: 8346 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctatctcctacttggcctctctactgggcctgccaagggtgcgtcctaaccggcgtctgggtcatagcccacgagtgcggccaccacgccttcagcgactac

SEQ ID NO: 8347 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 8348 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcctcgtctcctcctccctctaccacctctccacagcctacttccctctcctcccccaccctctcccttacctggcccctctactgggcctgccaaggctgcgtcctaacgggcctctgggtcatcgcccacgagtgcggccaccacgccttcagcgactac

SEQ ID NO: 8349 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactgcgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 8350 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaaggctgcgtcctaacgggcctctgggtcatcgcccacgaatgcggccaccacgccttcagcgactac

SEQ ID NO: 8351 - DNA, 347 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 8352 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctagccggcgtctgggtcatagcccacgagtgcggccaccacgccttcagcgactac

SEQ ID NO: 8353 - DNA, 351 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctcctccctggcctctctactgggcctgccaagggtgcgtcctaaccggcgtctgggtcatagcccacgagtgcggccaccacgccttcagcgactac

SEQ ID NO: 8354 - DNA, 415 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggagacgatggccaccacctgctggggggtcaagttgagcggggcacccgtcagtgcatgcatggcctctctactgtacctgccaagggtgcgtgctagcgggcctcaggatcatggcccacgagtgcggccgcaacgcctgcagcgactgc

SEQ ID NO: 8355 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctctccctctcccctccttgcctctctactgggcctgccaagggtgcgtcctaaccggcgtctgggtcatagcccacgagtgcggccaccacgccttcagcgactac

SEQ ID NO: 8356 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcctctgggtcatcgcccacgaatgcggccaccacgccttcagcgactac

SEQ ID NO: 8357 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtctgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaacgggcctctgggtcatcgcccacgaatgcggccaccacgccttcagcgactac

SEQ ID NO: 8358 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagccctcgagtgcggccaccacgccttcagcgactac

SEQ ID NO: 8359 - DNA, 387 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgccatcgtggctggcgatggccaccacctgctcctggcctctctactgggcctgccaagggtgcgtcctaacgggcctctgggtcatagcccacgagtgcggccaccacgccttcagcgactac

SEQ ID NO: 8360 - DNA, 334 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccacgagtgcggccaccacgccttcagcgactac

SEQ ID NO: 8361 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaggcctctctactgggcctgccaagggtgcgtcctaaccggcgtcttggtcatagcccacgagtgcggccaccacgccttcagcgactac

SEQ ID NO: 8362 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccgtcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaacgggcctctgggtcatagcccacgagtgcggccaccacgccttcagcgactac

SEQ ID NO: 8363 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaacgggcctctgggtcatagcccacgagtgcggccaccacgccttcagcgactac

SEQ ID NO: 8364 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcacaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgagtgcggccaccacgccttcagcgactac

SEQ ID NO: 8365 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaagggtgcgtcctaaccggcgtctgggtcatagcccacgagtgcggccaccacgccttcagcgactac

SEQ ID NO: 8366 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgtggcctctctactgggcctgccaagggtgcgtcctaaccggcgtctgggtcatagcccacgagtgcggccaccacgccttcagcgactac

SEQ ID NO: 8367 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctggcctctctactgggcctgccaagggtgcgtcctaaccggcgtctgggtcatagcccacgagtgcggccaccacgccttcagcgactac

SEQ ID NO: 8368 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccctctactgggcctgccaagggtgcgtcctaaccggcgtctgggtcatagcccacgagtgcggccaccacgccttcagcgactac

SEQ ID NO: 8369 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacattatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 8370 - DNA, 340 bp, Artificial
  Mutation in BnaC.FAD2.a introduced by TALE nuclease pair BnFAD2_T01
caggatccatgggtgcagttggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccaagggtgcgtcctaaccggcgtctgggtcatagcccacgagtgcggccaccacgccttcagcgactac

SEQ ID NO: 8371 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtcctaaccggcgtctgggtcatagcccacgagtgcggccaccacgccttcagcgactac

SEQ ID NO: 8372 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccatcagcgactac

SEQ ID NO: 8373 - DNA, 473 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaattccaccgcactgattcaaacgctcgatccctcgctctttctcctacctcatctgggacatcatcatagcctcctgcttctactacgtcgccaccacttacttccctctcctccctcaccctctctcctacttccagtctcatattcactctcaatccaaataatctgcaccggatctcgccctatcagccgttcccagctggtgaagtccgagctggaggagaagaataatggtggcaagcaggcgctggagtccctggcctctctactgggcctgccaagggtgcgtcctaaccggcgtctgggtcatagcccacgagtgcggccaccacgccttcagcgactac

SEQ ID NO: 8374 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccctggcctctctactgggcctgccaagggtgcgtcctaaccggcgtctgggtcatatcccgcgagtgcggccaccacgccttcagcgactac

SEQ ID NO: 8375 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgtgtcatagcccacgagtgcggccaccacgccttcagcgactac

SEQ ID NO: 8376 - DNA, 339 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctggcctctctactgggcctgccatgggtgcgtcctaaccggcgtctgggtcatagcccacgagtgcggccaccacgccatcagcgactac

SEQ ID NO: 8377 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttctggcctctctactgggcctgccaagggtgcgtcctaaccggcgtctgggtcatagcccacgagtgcggccaccacgccttcagcgactac

SEQ ID NO: 8378 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctggcctctctactgggcctgccaagggtgcgtcctaacgggcctctgggtcatagcccacgagtgcggccaccacgccttcagcgactac

SEQ ID NO: 8379 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaagggtgcgtcctaaccggcgtctgggtcatagcccgcgagtgcggccaccacgccttcagcgactac

SEQ ID NO: 8380 - DNA, 358 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctcgtctggcccctctactgggcctgccaaggctgcgtcctaacgggcctctgggtcatcgcccacgaatgcggccaccacgccttcagcgactac

SEQ ID NO: 8381 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggctgcgtcctaacgggcctctgggtcatagcccacgagtgcggccaccacgccttcagcgactac

SEQ ID NO: 8382 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagcgtgcgtcctaaccggcgtctgggtcatagccctcgagtgcggccaccactccttcagcgactac

SEQ ID NO: 8383 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgtcaagggtgcgtcctaaccggcgtctgggtcatagcccacgagtgcggccaccacgccttcagcgactac

SEQ ID NO: 8384 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 8385 - DNA, 348 bp, Artificial
  Mutation in BnaC.FAD2.a introduced by TALE nuclease pair BnFAD2_T01
caggatccattggtgcaggttgaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctaccaagggtgcgtcctaaccggcgtctgggtcatagcccacgagtgcggccaccacgccttcagcgactac

SEQ ID NO: 8386 - DNA, 400 bp, Artificial
  Mutation in BnaC.FAD2.a introduced by TALE nuclease pair BnFAD2_T01
caggtccatgggtgcaggtagaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccataaactgccaggcatcaaactaagcagaaggccatccgtccataggctggcctctctactgggcctgccaagggtgcgtcctaaccggcgtctgggtcatagcccacgagtgcggccaccacgccttcagcgactac

SEQ ID NO: 8387 - DNA, 339 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctcttcgacatcatcatctcctcctcggctcctccctctaccacctctccacagcctacttccctctccctcccctcgcctgacccctctactgggcctgccaaggctgcgtcctcacgggcctctgggtcatagcccacgagtgcggccaccacgccttcagcgactac

SEQ ID NO: 8388 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgtctctctactgggcctgccaagggtgcgtcctaaccggcgtctgggtcatagcccacgagtgcggccaccacgccttcagcgactac

SEQ ID NO: 8389 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctacttggcctctctactgggcctgccaagggtgcgtcctaaccggcgtctgggtcatagcccacgagtgcggccaccacgccttcagcgactac

SEQ ID NO: 8390 - DNA, 344 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcccccctcaccctctctcttggcctctctactgggcctgccaagggtgcgtcctaaccggcgtctgggtcatagcccacgagtgcggccaccacgccttcagcgactac

SEQ ID NO: 8391 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcataccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 8392 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 8393 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 8394 - DNA, 342 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagaccccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaagggtgcgtcctaaccggcgtctgggtcatagcccacgagtgcggccaccacgccttcagcgactac

SEQ ID NO: 8395 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaatcgctcgatccctcgctctttctcctacctcatctgggacatcatcatagcctcctgcttctactacgtcgccaccacttacttccctctcctccctcaccctctctctgtctctctactgggcatgccaagggtgcgtcctaaccggcgtctgggtcatagcccacgagtgcggccaccacgccttcagcgactac

SEQ ID NO: 8396 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 8397 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctttcctggcctctctactgggcctgccaagggtgcgtcctaaccggcgtctgggtcatagcccacgagtgcggccaccacgccttcagcgactac

SEQ ID NO: 8398 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaacgggcctctgggtcatcgcccacgaatgcggccaccacgccttcagcgactac

SEQ ID NO: 8399 - DNA, 355 bp, Artificial
  Mutation in BnaC.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctccccctctctcctacttcgcccctgacccctctactgggcctgccaaggctgcgtcctaaccggcgtctgggtcatagcccacgagtgcggccaccacgccttcagcgactac

SEQ ID NO: 8400 - DNA, 405 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcaatgcactgacgggtgccccgctcaacttgaccccccagcaggtggtggccatcggcctctctactgggcctgccaagggtgcgtcctaaccggcgtctgggtcatagcccacgagtgcggccaccacgccttcagcgactac

SEQ ID NO: 8401 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgagtcatagcccacgagtgcggccaccacgccttcagcgactac

SEQ ID NO: 8402 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctccttcggctctctactgggcctgccaagggtgcgtcctaaccggcgtctgggtcatagcccacgagtgcggccaccacgccttcagcgactac

SEQ ID NO: 8403 - DNA, 261 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 8404 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccgtctctcctaggcctctctactgggcctgccaagggtgcgtcctaaccggcgtctgggtcatagcccacgagtgcggccaccacgccttcagcgactac

SEQ ID NO: 8405 - DNA, 337 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctctactgggcctgccaagggtgcgtcctaaccggcgtctgggtcatagcccacgagtgcggccaccacgccgtcagcgactac

SEQ ID NO: 8406 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagaccgcgagtgcggccaccacgccttcagcgactac

SEQ ID NO: 8407 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcagcctctctactgggcctgccaagggtgcgtcctaaccggcgtctgggtcatagcccacgagtgcggccaccacgccttcagcgactac

SEQ ID NO: 8408 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccaccccttcagcgactac

SEQ ID NO: 8409 - DNA, 300 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtctctctactgggcctgccaagggtgcgtcctaacctgcgtctgggtcatagcccacgagtgcggccaccacgccttcagcgactac

SEQ ID NO: 8410 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgttgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 8411 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgccttcagcgactac

SEQ ID NO: 8412 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactgc

SEQ ID NO: 8413 - DNA, 348 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgaatgcggccaccacgccttcagcgactac

SEQ ID NO: 8414 - DNA, 358 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgccattcactgtcggagaactcaagaaagcaatcccaccgcactgtttcaaacgctcgatccctcgctctttctcatacctcatctgggacatcatcatagcctcctgcttctactacgtcgccaccacttacttccctctcctccctcaccctctctcctacttcgcctcgcctggcctctctactgggcctgccaagggtgcgtcctaaccggcgtctgggtcatagcccacgagtgcggccaccacgccttcagcgactac

SEQ ID NO: 8415 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttaccgtggcccctctactgggcctgccaaggctgcgtcctaaccggcgtctgggtcatagcccacgagtgcggccaccacgccttcagcgactac

SEQ ID NO: 8416 - DNA, 334 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccacgagtgcggccaccacgccttcagcgactac

SEQ ID NO: 8417 - DNA, 341 bp, Artificial
  Mutation in BnaC.FAD2.a introduced by TALE nuclease pair BnFAD2_T01
caggatccatgggtgcaggtggaagaatgcaagtctctcctacctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctggcctctctactgggcctgccaagggtgcgtcctaaccggcgtctgggtcatagcccacgagtgcggccaccacgccttcagcgactac

SEQ ID NO: 8418 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaaggctgcgtcctaacgggcctctgggtcatcgcccacgaatgcggccaccacgccttcagcgactac

SEQ ID NO: 8419 - DNA, 358 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctaacctggcctctctactgggcctgccaagggtgcgtcctaaccggcgtctgggtcatagcccacgagtgcggccaccacgccttcagcgactac

SEQ ID NO: 8420 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctcctctctactgggcctgccaagggtgcgtcctaaccggcgtctgggtcatagcccacgagtgcggccaccacgcattcagcgactac

SEQ ID NO: 8421 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaaggctgcgtcctaaccggcgtctgggtcatagcccacgagtgcggccaccacgccttcagcgactac

SEQ ID NO: 8422 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctccccttcggctctctactgggcctgccaagggtgcgtcctaaccggcgtctgggtcatagcccacgagtgcggccaccacgccttcagcgactac

SEQ ID NO: 8423 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 8424 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccctctctactgggcctgccaaggctgcgtcctaacgggcctctgggtcatagcccacgagtgcggccaccacgccttcagcgactac

SEQ ID NO: 8425 - DNA, 357 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggtgcctggcctctctactgggcctgccaagggtgcgtcctaaccggcgtctgggtcatagcccacgagtgcggccaccacgccttcagcgactac

SEQ ID NO: 8426 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggctgcgtcctaacgggcctctgggtcatagcccacgagtgcggccaccacgccttcagcgactac

SEQ ID NO: 8427 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctacctcaccctctctcctacttcggcctctctactgggcctgccaagggtgcgtcctaaccggcgtctgggtcatagcccacgagtgcggccaccacgccttcagcgactac

SEQ ID NO: 8428 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 8429 - DNA, 321 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaaccggcgtctgggtcatagtccacgagtgcggccaccacgccttcagcgactac

SEQ ID NO: 8430 - DNA, 346 bp, Artificial
  Mutation in BnaC.FAD2.a introduced by TALE nuclease pair BnFAD2_T01
caggatccatgggtgcaggtggaagaatgcaagtgtctccccctccaagaagtctgaaacctacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattggcctctctactgggcctgccaagggtgcgtcctaaccggcgtctgggtcatagcccacgagtgcggccaccacgccttcagcgactac

SEQ ID NO: 8431 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggtggcctctctactgggcctgccaaggctgcgtcctaacgggcctctgggtcatagcccacgagtgcggccaccacgccttcagcgactac

SEQ ID NO: 8432 - DNA, 345 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttctctctactgggcctgccaagggtgcgtcctaaccggcgtctgggtcatagcccacgagtgcggccaccacgccttcagcgactac

SEQ ID NO: 8433 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttcgcctggcctctctactgggcctgccaagggtgcgtcctaaccggcgtctgggtcatatcccacgagtgcggccaccacgccttcagcgactac

SEQ ID NO: 8434 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgtgacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 8435 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccgacgtctgggtcatagcccacgagtgcggccaccacgccttcacgactac

SEQ ID NO: 8436 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacacaatcaagcgcgtaccctgcgagacaccgccctacactgtcggagaactcaagaaagcaatcccaccgcactgtttcaaacgctcgatccctcgctctttctcctacctcatctgggacatcaccatagcctcctgcttctactacctcgccaccacttacttacctctcctccctcaccctctctcctacttcgtggtggcctctctactgggcctgccaagggtgcgtcctaaccggcgtctgggtcatagcccacgagtgcggccaccacgccttcatcgactac

SEQ ID NO: 8437 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttggcctctctactgggcctgccaagggtgcgtcctcaccggcgtctgggtcatagcccacgagtgcggccaccacgccttcagcgactac

SEQ ID NO: 8438 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttcactctcctccctcaccctctctcctgggcctgccaagggtgcgtcctaaccggcgtctgggtcatagcccacgagtgcggccaccacgccttcagcgactac

SEQ ID NO: 8439 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctattacgtcgccaccacttacttccctctcctccctcaccctctctcctgggcctgccaagggtgcgtcctaaccggcgtctgggtcatagcccacgagtgcggccaccacgccttcagcgactac

SEQ ID NO: 8440 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 8441 - DNA, 387 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgccatcgtggctggcgatggccaccacctgctcctggcctctctactgggcctgccaagggtgcgtcctaaccggcgtctgggtcatagcccacgagtgcggccaccacgccttcagcgactac

SEQ ID NO: 8442 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagatagcaatcccaccgcactgtttcaaacgctcgatccctcgctctttctcctacctcatctgggacatcatcatagcctcctgcttctactacgtcgccaccacttacttccctctcctccctcaccccccctcctacccctggcctctctactgggcctgccaagggtgcgtcctaaccggcgtctgggtcatagcccacgagtgcggccaccacgccttcagcgactac

SEQ ID NO: 8443 - DNA, 318 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccactgggcaggcccctctactgggcctgccaaggctgcgtcctaacgggcctctgggtcatcgcccacgaatgcggccaccacgccttcagcgactac

SEQ ID NO: 8444 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctggaactgccaagggtgcgtcctaaccggcgtctgggtcatagcccacgagtgcggccaccacgccttcagcgactac

SEQ ID NO: 8445 - DNA, 398 bp, Artificial
  Mutation in BnaC.FAD2.a introduced by TALE nuclease pair BnFAD2_T01
caggatccatgggtgcaggaggaagaatgcaagtgtctcctccctccaagaagtctgaaaccgacaccatcaagcgcgtaccctgcgagacaccgcccttcactgtcggagaactcaagaaagcaatcccaccgcactgtttcaaaccctcgatcccgcgctctttctcctaccccctctgggacatcatcatagcctcctgcttctactacgtcgccaccacttacttccctctcctccctcaccctctctgccaacttcccaagattgcaaaccgtggcggcgtgaccgcagtggaggcagtgcatgcgcctctctactgggcctgccaagggtgcgtcctaaccggcgtctgggtcatagcccacgagtgcggccaccacgccttcagcgactac

SEQ ID NO: 8446 - DNA, 344 bp, Artificial
  Mutation in BnaC.FAD2.a introduced by TALE nuclease pair BnFAD2_T01
caggatccatgggtgcaggtggaagaatgcaagtctctcctccctccagctcccccgcaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgtggcctctctactgggcctgccaagggtgcgtcctaaccggcgtctgggtcatagcccacgagtgcggccaccacgccttcagcgactac

SEQ ID NO: 8447 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgccttcagtgactac

SEQ ID NO: 8448 - DNA, 335 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgtcctaaccggcgtctgggtcatagcccacgagtgcggccaccacgccttcagcgactac

SEQ ID NO: 8449 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaatggtgcgtcctaaccggcgtctgggtcatagcccacgagtgcggccaccacgccttcagcgactac

SEQ ID NO: 8450 - DNA, 358 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccccgcctagcctggcctctatactgggcctgccaagggtgcgtcctaaccggcgtctgggtcatagcccacgagtgcggccaccacgccttcagcgactac

SEQ ID NO: 8451 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgaggcctctctactgggcctgccaagggtgcgtcctaaccggcgtctgggtcatagcccacgagtgcggccaccacgccttcagcgactac

SEQ ID NO: 8452 - DNA, 354 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgtggtggcctctctactgggcctgccaagggtgcgtcctaaccggcgtctgggtcatagcccacgagtgcggccaccacgccttcagcgactac

SEQ ID NO: 8453 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttcccttggcccctctactgggcctgccaaggctgcgtcctaacgggcctctgggtcatcgcccacgaatgcggccaccacgccttcagcgactac

SEQ ID NO: 8454 - DNA, 321 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcaagggtgcgtcctaaccggcgtctgggtcatagcccacgagtgcggccaccacgccttcagcgactac

SEQ ID NO: 8455 - DNA, 374 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccaggcttatcttggacaagaagaagatcgctctctactgggcctgccaaggctgcgtcctaaccggcgtctgggtcatagcccacgagtgcggccaccacgccttcagctactac

SEQ ID NO: 8456 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagacctcaagaaagcaatcccaccgcactgtttcaaacgctcgatccctcgctctgtatcctacctcatctgggacatcatcatagcctcctgcttctactacgtcgccaccacttacttccctctcctccctcaccctctctcctactgtggcctctctactgggcctgccaagggtgcgtcctaaccggcgtctgggtcatagcccacgagtgcggccaccacgccttcagcgactac

SEQ ID NO: 8457 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtttgaaaccgacaccatcaagcgcgtaccctgcgagacaccgcccttcactggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcctggcctctctactgggcctgccaagggtgcgtcctaaccggcgtctgggtcatagcccacgagtgcggccaccacgccttcagcgactac

SEQ ID NO: 8458 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaattccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 8459 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctggtacatcatcatagcctcctgcttctactacgtcgccaccacttactcccctctcctccctcaccctctctcctacttcgcctctctactgggcctgccaagggtgcgtcctaaccggcgtctgggtcatagcccacgagtgcggccaccacgccttcagcgactac

SEQ ID NO: 8460 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgagtgcggccaccacgccttcagcgactac

SEQ ID NO: 8461 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgtccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcctggcctctctactgggcctgccaagggtgcgtcctaaccggcgtctgggtcatagcccacgagtgcggccaccacgccttcagcgactac

SEQ ID NO: 8462 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctacttctactacgtcgccaccacttacttccctctcctccctcacccgctctcctaggccgctctacgggacctgccaagggtgcgtcctaaccggcgtctgggtcatagcccacgagtgcggccaccacgccttcagcaactac

SEQ ID NO: 8463 - DNA, 355 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcctggcctctctactgggcctgccaagggtgcgtcctaaccggcgtctgggtcatagcccacgagtgcggccaccacgccttcagcgactac

SEQ ID NO: 8464 - DNA, 433 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtaaagtcgcctaaggtcactatcagctagcaaatatttcttgtcaaagtgatgagcaatgcttttttataatgccaacttgcgcctggcctctctactgggcctgccaagggtgcgtcctaaccggcggctgggtcatagcccacgagtgcggccagcacgccttcagcgactac

SEQ ID NO: 8465 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaaggttgcgtcctaacgggcctctgggtcatagcccacgagtgcggccaccacgccttcagcgactac

SEQ ID NO: 8466 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacctcgcggcctctctactgggcctgccaagggtgcgtcctaaccggcgtctgggtcatagcccacgagtgcggccaccacgccttcagcgactac

SEQ ID NO: 8467 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgacggcctctctactgggcctgccaagggtgcttccgaaccggcgtctgggtcatagcccacgagtgcggccaccacgccttcagcgactac

SEQ ID NO: 8468 - DNA, 337 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctactgggcctgccaaggctgcgtcctaacgggcctctgggtcatagcccacgagtgcggccaccacgccttcagcgactac

SEQ ID NO: 8469 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcgcctggcctctctactgggcctgccaagggtgcgtcctaaccggcgtctgggtcatagccaacgagtgcggccaccacgccttcagcgactac

SEQ ID NO: 8470 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttacctctctactgggcctgccaagggtgcgtcctaaccggcgtctgggtcatagcccacgagtgcggccaccacgccttcagcgactac

SEQ ID NO: 8471 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacctctctactgggcctgccaagggtgcgtcctaaccggcgtctgggtcatagcccacgagtgcggccaccacgccttcagcgactac

SEQ ID NO: 8472 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttgcccctctactgggcctgccaaggctgcgtcctaacgggcctctgggtcatcgcccacgaatgcggccaccacgccttcagcgactac

SEQ ID NO: 8473 - DNA, 346 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 8474 - DNA, 340 bp, Artificial
  Mutation in BnaC.FAD2.a introduced by TALE nuclease pair BnFAD2_T01
caggatccatgggtgcaggtgcaagaatgcaagtgtctcctccctcccagaagtctgaaaccgacaccatcaagcgcgtaccctgcgagacaccgcccttcactgtcggagacctcaagaaagcaatcccacctcactgcttcaaacgctccatcccacgctccttctcctcttcgacatcatcatagcctactgcttctactacgtcgccaccacttacttccctctcctccctcaccctctctcctactggcctctctactgggcctgccaagggtgcgtcctaaccggcttctgggtcatagcccacgagtgcggccaccacgccttcagcgactac

SEQ ID NO: 8475 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtaggagaactcaagaaagcaatcccaccgcactgtttcaaacgctcgatccctcgctctttctcctacctcatctgggacataatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 8476 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttaccttggcccctctactggtcctgccaaggctgcgtcctaaccggcgtctgggtcataaccctcgagtgcggccaccacgccttcagcgactgc

SEQ ID NO: 8477 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacactgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaagggtgcgtcctaaccggcgtctgggtcatagcccacgagtgcggccaccacgccttcagcgactac

SEQ ID NO: 8478 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcggcctctctactgggcctgccaagggtgcgtcctaaccggcgtctgggtcatagcccacgagtgcggccaccacgccttcagcgactac

SEQ ID NO: 8479 - DNA, 343 bp, Artificial
  Mutation in BnaC.FAD2.a introduced by TALE nuclease pair BnFAD2_T01
caggatccatgggtgcaggtggcagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 8480 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccatgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgcctcagcgactac

SEQ ID NO: 8481 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaactctctactgggcctgccaagggtgcgtcctaaccggcgtctgggtcatagcccacgagtgcggccaccacgccttcagcgactac

SEQ ID NO: 8482 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacctggcctctctactgggcctgccaagggtgcgtcctaaccggcgtctgggtcatagcccacgagtgcggccaccacgccttcagcgactac

SEQ ID NO: 8483 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgccatcagcgactac

SEQ ID NO: 8484 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagtgtgcgtcctaaccggcgtctgggtcatagcccacgagtgcggccaccacgccttcagcgactac

SEQ ID NO: 8485 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgtcctctctactgggcctgccaagggtgcgtcctaaccggcgtctgggtcatagcccacgagtgcggccaccacgccttcagcgactac

SEQ ID NO: 8486 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccacttcgcctctctactgggcctgccaagggtgcgtcctaaccggcgtctgggtcatagcccacgagtgcggccaccacgccttcagcgactac

SEQ ID NO: 8487 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttatactacgtcgccaccacttacttccctctcctccctcaccctctctcctccttcgcctctctactgggcctgccaagggtgcgtcctaaccggcgtctgggtcatagcccacgagtgcggccaccacgccttcagcgactac

SEQ ID NO: 8488 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccaaggctgcgtcctaacgggcctctgggtcatagcccacgagtgcggccaccacgccttcagcgactac

SEQ ID NO: 8489 - DNA, 346 bp, Artificial
  Mutation in BnaC.FAD2.a introduced by TALE nuclease pair BnFAD2_T01
caggatccatgggtgcagggggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcccctcccccaccccctcccttccctcccctctactgggcctgccaaggctgcgtcctaacgggcctctgggtcatcgcccacgaatgcggccaccacgccttcagcgactac

SEQ ID NO: 8490 - DNA, 355 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcccctggcctctctactgggcctgccaagggtgcgtcctaaccggcgtctgggtcatagcccacgagtgcggccaccacgccttcagcgactac

SEQ ID NO: 8491 - DNA, 356 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgacgcctggcctctctactgggcctgccaagggtgcgtcctcaccggcgtctgggtcatagcccacgagtgcggccaccacgccttcagcgactac

SEQ ID NO: 8492 - DNA, 339 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccatcaccctctggcctctctactgggcctgccaagggtgcgtcctaaccggcgtctgggtcatagcccacgagtgcggccaccacgccttcagcgactac

SEQ ID NO: 8493 - DNA, 356 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 8494 - DNA, 324 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcttgccaagggtgcgtcctaaccggcgtctgggtcatagcccacgagtgcggccaccacgccttcagcgactac

SEQ ID NO: 8495 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcttagcctcctgcttctactacgtcgccaccacttacttccctctcctccctcaccctccctcctgcctctctactgggcctgccaagggtgcgtcctgaccggcgtctgggtcatagcccacgagtgcggccaccacgccttcagcgactac

SEQ ID NO: 8496 - DNA, 323 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaagggtgcgtcctaaccggcgtctgggtcatagcccacgagtgcggccaccacgccttcagcgactac

SEQ ID NO: 8497 - DNA, 354 bp, Artificial
  Mutation in BnaC.FAD2.a introduced by TALE nuclease pair BnFAD2_T01
taggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggtggcctctctactgggcctgccaagggtgcgtcctaaccggcgtctgggtcatagcccacgagtgcggccaccacgccttcagcgactac

SEQ ID NO: 8498 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 8499 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggctgcgtcctaacgggcctctgggtcatagcccacgagtgcggccaccacgccttcagcgactac

SEQ ID NO: 8500 - DNA, 440 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccccagtggctgttgccaccattattgctggcgatggccaccacctgctggggggtcaagccgtgggatcagggcgagataactgggcaacaatgctctccagcgccggcctctctactgggcctgccaagggtgcgtcctaaccggcgtctgggtcatagcccacgagtgcggccaccacgccttcagcgactac

SEQ ID NO: 8501 - DNA, 354 bp, Artificial
  Mutation in BnaC.FAD2.a introduced by TALE nuclease pair BnFAD2_T01
caggatccatgggtgcaggtgccagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctccgcctggcccctctactgggcctgccaaggctgcgtcctaacgggcctctgggtcatcgcccacgaatgcggccaccacgccttcagcgactac

SEQ ID NO: 8502 - DNA, 350 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagggcggccaccacgccttcagcgactac

SEQ ID NO: 8503 - DNA, 419 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacacagcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcaggcgctgttgccggtgctgtgccaggcccacggcttgaccccccagcaggtggtggccatcgccagatggcctctctactgggcctgccaagggtgcgtcctaaccggcgtctgggtcatagcccacgagtgcggccaccacgccttcagcgactac

SEQ ID NO: 8504 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgcctctctactgggcctgccaagggtgcgtcctaaccggcgtctgggtcatagcccacgagtgcggccaccacgccttcagcgactac

SEQ ID NO: 8505 - DNA, 342 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgcctctctactgggcctgccaagggtgcgtcctaaccggcgtctgggtcatagcccacgagtgcggccaccacgccttcagcgactac

SEQ ID NO: 8506 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcaccatagcctcctgcttctactacgtcgccaccacttacttccctctcctccctcaccctctcccctacctctctactgggcctgccaagggtgcgtcctaaccggcgtctgggtcatagcccacgagtgcggccaccacgccttcagcgactac

SEQ ID NO: 8507 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaaccggcgtctgggtcatagcccacgagtgcggccaccacgccttcagcgactac

SEQ ID NO: 8508 - DNA, 348 bp, Artificial
  Mutation in BnaC.FAD2.a introduced by TALE nuclease pair BnFAD2_T01
caggatccattggtgcaggtggaagaatgcaagtctctcctccctccagctcccccgaaaccaaaaccctcaaacgcgtcccctgcgagacaccacccctcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 8509 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctggttcatagcccacgagtgcggccaccacgcctgcagcgactac

SEQ ID NO: 8510 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgagtgcggccaccacgccttcagcgactac

SEQ ID NO: 8511 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatcgcccacgaatgcggccaccacgccttcagcgactac

SEQ ID NO: 8512 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 8513 - DNA, 344 bp, Artificial
  Mutation in BnaC.FAD2.a introduced by TALE nuclease pair BnFAD2_T01
caggatccatgggtgcaggtggaagaatgcaagtgcctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 8514 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaatggcctctctactgggcctgccaagggtgcgtcctaaccggcgtcttggtcatagcccacgagtgcggccaccacgccttcagcgactac

SEQ ID NO: 8515 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttccactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 8516 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttggcctctctaccgggcctgccgagggtgcgtcctaaccggcgtctgggtcatagcccacgagtgcgtccaccacgccttcagcgactac

SEQ ID NO: 8517 - DNA, 309 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacaggcctctgggtcatcgcccacgagtgcggccaccacgccttcagcgactac

SEQ ID NO: 8518 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctgcctctctactgggcctgccaaggctgcgtcctaacgggcctctgggtcatagcccacgagtgcggccaccacgccttcagcgactac

SEQ ID NO: 8519 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgatac

SEQ ID NO: 8520 - DNA, 440 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccccagcggctgttgccaccattattgctggcgatggccaccacctgctggggggtcaagccgtgggatcagggcgagataactgggcaacaatgctctccagcgccggcctctctactgggcctgccaagggtgcgtcctaaccggcgtctgggtcatagcccacgagtgcggccaccacgccttcagcgactac

SEQ ID NO: 8521 - DNA, 343 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccatcaccctctcccctaactctctactgggcctgccaagggtgcgtcctaaccggcgtctgggtcatagcccacgagtgcggccaccacgccttcagcgactac

SEQ ID NO: 8522 - DNA, 352 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgctggcctctctactgggcctgccaagggtgcgtcctaaccggcgtctgggtcatagcccacgagtgcggccaccacgccttcagcgactac

SEQ ID NO: 8523 - DNA, 378 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactccgcctccagcgcctgcttgccgccatcgtggctggcgatggccaccacctgctccggggtcaagccgtgagggctgggtcatagcccacgagtgcggccaccacgccttcagcgactac

SEQ ID NO: 8524 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgtcaagggtgcgtcctaaccggcgtctgggtcatagcccacgagtgcggccaccacgccttcagcgactac

SEQ ID NO: 8525 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 8526 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaaggctgcgtcctaacgggcgtctgggtcatagcccacgagtgcggccaccacgccttcagcgactac

SEQ ID NO: 8527 - DNA, 345 bp, Artificial
  Mutation in BnaC.FAD2.a introduced by TALE nuclease pair BnFAD2_T01
caggatccatgggtgcaggttgaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgccttcagcgactac

SEQ ID NO: 8528 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttggcctctctactgggcctgccaagggtgcgtcctaaccggcgtctgggtcatagcccacgagtgcggccaccacgccttcagcgactac

SEQ ID NO: 8529 - DNA, 338 bp, Artificial
  Mutation in BnaC.FAD2.a introduced by TALE nuclease pair BnFAD2_T01
caggatccatgggtgcaggtggcagaatgcaagtgtctactcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaagggtgcgtcctaaccggcgtctgggtcatagcccacgagtgcggccaccacgccttcagcgactac

SEQ ID NO: 8530 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 8531 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcactcaccctctctcctacttgcctctctactgggcctgccaagggtgcgtcctaaccggcgtctgggtcatagcccacgagtgcggccaccacgccttcagcgactac

SEQ ID NO: 8532 - DNA, 318 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccctcaaacgcgtaccctgcgagacaccacccttcactgtcggagaactcaagaaagcaatcccaccgcactgtttcaaacgctcgatccctcgctccttctcctacctcatctggcacatcatcatagcctcctgcctctactacgtcgccaccacttgcccggcctctctactgggcctgccaagggtgcgtcctaaccggcgtctgggtcatagcccacgagtgcggccaccacgccttcagcgactac

SEQ ID NO: 8533 - DNA, 341 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctctactgggcctgccaaggctgcgtcctaacgggcctctgggtcatagcccacgagtgcggccaccacgccttcagcgactac

SEQ ID NO: 8534 - DNA, 342 bp, Artificial
  Mutation in BnaC.FAD2.a introduced by TALE nuclease pair BnFAD2_T01
caggatccatgggtgcaggtggaagaatgcaagtgtctcctccccccaaaaagtctgaaaccgacaccatcaagcgcgtaccctgcgagacaccgcccttaactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaagggtgcgtcctaaccggcgtctgggtcatagcccacgagtgcggccaccacgccttcagcgactac

SEQ ID NO: 8535 - DNA, 312 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaacgggcctctgggtcatcgcccacgaatgcggccaccacgccttcagcgactac

SEQ ID NO: 8536 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctccctcatctgggccatcaccatagcctcctgcttctcctccgccgcccccacttacttccctctcctccctcaccctctctcctaccctggcctctctactgggcctgccaagggtgcgtcctaaccggcgtctgggtcatagcccacgagtgcggccaccacgccttcagcgactac

SEQ ID NO: 8537 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctcccctgcctctctactgggcctgccaagggtgcgtcctaaccggcgtctgggtcatagcccacgagtgcggccaccacgccttcagcgactac

SEQ ID NO: 8538 - DNA, 354 bp, Artificial
  Mutation in BnaC.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttccgcctggcctctctactgggcctgccaagggtgcgtcctaacgggcctctgggtcatagcccacgagtgcggccaccacgccttcagcgactac

SEQ ID NO: 8539 - DNA, 348 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacagcgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctggttcatagcccacgagtgctgccaccacgccttcagcgactac

SEQ ID NO: 8540 - DNA, 349 bp, Artificial
  Mutation in BnaC.FAD2.a introduced by TALE nuclease pair BnFAD2_T01
caggatccatgggtgcaggtgaaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 8541 - DNA, 337 bp, Artificial
  Mutation in BnaC.FAD2.a introduced by TALE nuclease pair BnFAD2_T01
caggatccatgggtgcaggtggcagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctctactgggcctgccaagggtgcgtcctaaccggcgtctgggtcatagcccacgagtgcggccaccacgccttcagcgactac

SEQ ID NO: 8542 - DNA, 345 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgccttcagcgactac

SEQ ID NO: 8543 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 8544 - DNA, 350 bp, Artificial
  Mutation in BnaC.FAD2.a introduced by TALE nuclease pair BnFAD2_T01
caggatccatgggtgcaggtggaagaatgcaagtgcctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttcccgctcctccctcaccctctctcctacttctggcctctctactgggcctgccaagggtgcgtcctaaccggcgtctgggtcatagcccacgagtgcggccaccacgccttcagcgactac

SEQ ID NO: 8545 - DNA, 398 bp, Artificial
  Mutation in BnaC.FAD2.a introduced by TALE nuclease pair BnFAD2_T01
caggatccatgggtgcaggcggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgccaacttctcaagattgcaaaacgtggcggcgtgacagcagtggaggcagtgcatgcgcctctctactgggcctgccaagggtgcgtcctaaccggcgtctgggtcatagcccacgagtgcggccaccacgccttcagcgactac

SEQ ID NO: 8546 - DNA, 321 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaacgggcctctgggtcatcgcccacgaatgcggccaccacgccatcagcgactac

SEQ ID NO: 8547 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgtgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaaccggcgtctgggtcatagcccacgagtgcggccaccacgccttcagcgactac

SEQ ID NO: 8548 - DNA, 324 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcgaagaactcaagaaagcaatcccaccacactgtttcaaacgctcgatccctcgctctttctcctacctcatctgggacatcatcatagcctcctgcttctactacgtcgccaccacttacttccctctcctccctcaccctctctcgccaagggtgcgtcctaaccggcgtctgggtcatagcccacgagtgcggccaccacgccttcagcgactac

SEQ ID NO: 8549 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatccaaccgcactgtttcaaacgctcgatccctcgctctttctcctacctgatctgggacatcatcatagcctcctgcttctactacgtcgccaccacttacttccctctcctccctcaccctctctcctactgggcctgccaagggtgcgtcctaaccggcgtctgggtcatagcccacgagtgcggccaccacgccttcagcgactac

SEQ ID NO: 8550 - DNA, 353 bp, Artificial
  Mutation in BnaC.FAD2.a introduced by TALE nuclease pair BnFAD2_T01
caggatccatgggtgcaggtggcagaatgcaagtgtctcctccctccaagaagtatgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggtggcccctctactgggcctgccaagggtgcgtcctaaccggcgtctgggtcatagcccacgagtgcggccaccacgccttcgcgactac

SEQ ID NO: 8551 - DNA, 339 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtccgggtcatagcccacgaatgcggccaccacgccttcagcgactac

SEQ ID NO: 8552 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttctggcctctctactgggcctgccaagggtgcgtcctaaccggcgtctgggtcatagcccacgagtgcggccaccacgccttcagcgactac

SEQ ID NO: 8553 - DNA, 348 bp, Artificial
  Mutation in BnaC.FAD2.a introduced by TALE nuclease pair BnFAD2_T01
caggatccatgggtgcaggtggaagaatgcaagtatctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcccacttggcctctctactgggcctgccaagggtgcgtcctaaccggcgtctgggtcatagcccacgagtgcggccaccacgccttcagcgactac

SEQ ID NO: 8554 - DNA, 337 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctactgggcctgccaagggtgcgtcctaaccggcgtctgggtcatagcccacgagtgcggccaccacgccttcagcgactac

SEQ ID NO: 8555 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaatggcctctctactgggcctgccaaggctgcgtcctaaccggcgtctgggtcatagcccacgagtgcggccaccacgccttcagcgactac

SEQ ID NO: 8556 - DNA, 347 bp, Artificial
  Mutation in BnaC.FAD2.a introduced by TALE nuclease pair BnFAD2_T01
caggatccatgggtgcaggtggaagaatgcaagtgcctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 8557 - DNA, 354 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttcgcctggcctctctacggggcctgccaagggtgcgtcctaaccggcgtctgggtcatagcccacgagtgcggccaccacgccttcagcgactac

SEQ ID NO: 8558 - DNA, 335 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttagcctgccaagggtgcgtcctaacgggcctctgggtcatagcccacgagtgcggccaccacgccttcagcgactac

SEQ ID NO: 8559 - DNA, 341 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctggcctctctactgggcctgccaagggtgcgtcctaaccggcgtctgggtcatagcccacgagtgcggccaccacgccttcagcgactac

SEQ ID NO: 8560 - DNA, 339 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgggtcatagcccacgagggcggccaccacgccttcagcgactac

SEQ ID NO: 8561 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacactcgatccctcgctctttctcctacctcatctgggacatcatcatagcctcctgcttctactacgtcgccaccacttacttccctctcctccctcaccctctctcctacttcgctggcctctctactgggcctgccaagggtgcgtcctaaccggcgtctgggtcatagcccacgagtgcggccaccacgccttcagcgactac

SEQ ID NO: 8562 - DNA, 334 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctgccaagggtgcgtcctaaccggcgtctgggtcatagcccacgagtgcggccaccacgccttcagcgactac

SEQ ID NO: 8563 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctaccctggcctctctactgggcctgccaagggtgcgtcctaaccggcgtctgggtcatagcccacgagtgcggccaccacgccttcagcgactac

SEQ ID NO: 8564 - DNA, 349 bp, Artificial
  Mutation in BnaC.FAD2.a introduced by TALE nuclease pair BnFAD2_T01
caggatccatgggtgcaggtggaagaatgcaagtgtctcctcactccaaaaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctatcctccctcaccctctctcctacccgggcctcgctactgtgcctgccaagggtgcgtcctaaccggcggctgggtcatagcccacgagtgcggccaccacgcctgcagcgactac

SEQ ID NO: 8565 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccaaggctgcgtcctaacgggcctctgggtcatagcccacgagtgcggccaccacgccttcagcgactac

SEQ ID NO: 8566 - DNA, 312 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 8567 - DNA, 300 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccaagggtgcgtcctaacgggcctctgggtgatagcccacgagggcggccaccacgccgtcagcgacgac

SEQ ID NO: 8568 - DNA, 389 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccacccacgtataaaccgtcgatgccctgctgaatattgaactgaaccaggcgactggcctctctactgggcctgccaagggtgcgtcctaacgggcctctgggtcatcgcccacgaatgcggccaccacgccttcagcgactac

SEQ ID NO: 8569 - DNA, 349 bp, Artificial
  Mutation in BnaC.FAD2.a introduced by TALE nuclease pair BnFAD2_T01
caggatccatgggtgcaggcggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcggcctctctactgggcctgccaaggctgcgtcctaacgggcctctgggtcatcgcccacgagtgcggccaccacgccttcagcgactac

SEQ ID NO: 8570 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgctggcctctctactgggcctgccaagggtgcgtcctaaccggcgtctgggtcatagcccacgagtgcggccaccacgccttcagcgactac

SEQ ID NO: 8571 - DNA, 357 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcgcgcctggcctctctactgggccggccaagggtgcgtcctaaccggcgtctgggtcatagcccacgagtgcggccaccacgccttcagcgactac

SEQ ID NO: 8572 - DNA, 349 bp, Artificial
  Mutation in BnaC.FAD2.a introduced by TALE nuclease pair BnFAD2_T01
caggatccatgggtgcaggtgccagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccacgacgccttcagcgactac

SEQ ID NO: 8573 - DNA, 395 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccgcaaactcttcctggctagcggtacgcgtattaattgcgtcctggcctctctactgggcctgccaagggtgcgtcctaaccggcgtctgggtcatagcccacgagtgcggccaccacgccttcagcgactac

SEQ ID NO: 8574 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctggcctctctactgggcctgccaagggtgcgtcctaaccggcgtctgggtcatagcccacgagtgcggccaccacgccttcagcgactac

SEQ ID NO: 8575 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaaggctgcgtcctaacgggcctctgggtcatcgcccacgaatgcggccaccacgccttcagcgactac

SEQ ID NO: 8576 - DNA, 344 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcttggcctctctactgggcctgccaagggtgcgtcctaaccggcgtctgggtcatagcccacgagtgcggccaccacgccttcagcgactac

SEQ ID NO: 8577 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccaagggtgcgtcctaaccggcgtctgggtcatagcccacgagtgcggccaccacgccttcagcgactac

SEQ ID NO: 8578 - DNA, 347 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 8579 - DNA, 340 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttctctactgggcctgccaagggtgcgtcctaaccggcgtctgggtcatagcccacgagtgcggccaccacgccttcagcgactac

SEQ ID NO: 8580 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtatcctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgaatgcggccaccacgccttcagcgactac

SEQ ID NO: 8581 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcttggcctctctactgggcctgccaagggtgcgtcctaacgggcctctgggtcatagcccacgagtgcggccaccacgccttcagcgactac

SEQ ID NO: 8582 - DNA, 339 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctctctactgggcctgccaaggctgcgtcctaacgggcctctgggtcatagcccacgagtgcggccaccacgccttcagcgactac

SEQ ID NO: 8583 - DNA, 349 bp, Artificial
  Mutation in BnaC.FAD2.a introduced by TALE nuclease pair BnFAD2_T01
caggatccatgggtgcaggtgccagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcggcctctctactgggcctgccaagggtgcgtcctaaccggcgtctgggtcatagcccacgagtgcggccaccacgccttcagcgactac

SEQ ID NO: 8584 - DNA, 344 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccactgcactgtttcaaacgctcgatccctcgctctttctcctacctcatctgggacatcatcatagcctcctgcttctactacgtcgccaccacttacttccctctcctccctcaccctctctcctggcctctctactgggcctgccaagggtgcgtcctaaccggcgtctgggtcatagcccacgagtgcggccaccacgccttcagcgactac

SEQ ID NO: 8585 - DNA, 351 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcctctctactgggcctgccaagggtgcgtcctaaccggcgtctgggtcatagcccacgaatgcggccaccacgccttcagcgactac

SEQ ID NO: 8586 - DNA, 334 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccacgagtgcggccaccacgccttcagcgactac

SEQ ID NO: 8587 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 8588 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttctctactgggcctgccaagggtgcgtcctaaccggcggctgggtcatagcccacgagtgcggccaccacgccttcagcgactac

SEQ ID NO: 8589 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctggcctctctactgggcctgccaagggtgcgtcctaaccggcgtctgggtcatagcccacgagtgcggccaccacgccttcagcgactac

SEQ ID NO: 8590 - DNA, 343 bp, Artificial
  Mutation in BnaC.FAD2.a introduced by TALE nuclease pair BnFAD2_T01
caggatccatgggtgcaggtggcagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccccctcccctacctctctactgggcctgccaaggctgcgtcctaacgggcctctgggtcatagcccacgagtgcggccaccacgccatcagcgactac

SEQ ID NO: 8591 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccctactgggcctgccaagggtgcgtcctaaccggcgtctgggtcatagcccacgagtgcggccaccacgccgtcagcgactac

SEQ ID NO: 8592 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaaacaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 8593 - DNA, 378 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctttgatccggttcctgaacaggatctatttgatggcctctctactgggcctgccaagggtgcgtcctaaccggcgtctgggtcatagcccacgagtgcggccaccacgccttcagcgactac

SEQ ID NO: 8594 - DNA, 349 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaacatcaagcgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgccctctctactgggcctgccaagggtgcgtcctaaccggcgtctgggtcatagcccacgagtgcggccaccacgccttcagcgactac

SEQ ID NO: 8595 - DNA, 343 bp, Artificial
  Mutation in BnaC.FAD2.a introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 8596 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccataaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccgcctggcctctctactgggcctgccaagggtgcgtcctaaccggcggctgggtcatagcccacgagtgcggccaccacgccttcagcgactac

SEQ ID NO: 8597 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccccggcctctctactgggcctgccaaggctgcgtcctaaccggcgtctgggtcatagcccacgagtgcggccaccacgccttcagcgactac

SEQ ID NO: 8598 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttctctactgggcctgccaagggtgcgtcctaaccggcgtctgggtcatagcccacgagtgcggccaccacgccttcagcgactac

SEQ ID NO: 8599 - DNA, 347 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 8600 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaagggtgcgtcctaaccggcgtctgggtcatagcccacgagtgcggccaccacgccttcagcgactac

SEQ ID NO: 8601 - DNA, 397 bp, Artificial
  Mutation in BnaC.FAD2.a introduced by TALE nuclease pair BnFAD2_T01
caggatccatgggtgcaggtggaagaatgcatgtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttgccttggcaacgctgcgatcatgtcctgatacttgacagcgacggtccctggcctctctactgggcctgccaagggtgcgtcctaaccggcgtctgggtcatagcccacgagtgcggccaccacgccttcagcgctac

SEQ ID NO: 8602 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactggacctgccaagggtgcgtcctaaccggcgtctgggtcatagcccacgagtgcggccaccacgccttcagcgactac

SEQ ID NO: 8603 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgtcctaaccggcgtctgggtcatagcccacgagtgcggccaccacgccttcagcgactac

SEQ ID NO: 8604 - DNA, 354 bp, Artificial
  Mutation in BnaC.FAD2.a introduced by TALE nuclease pair BnFAD2_T01
caggatccatgtgtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccgcctggcctctctactgggcctgccaagggtgcgtcctaaccggcgtctgggtcatagcccacgagtgcggccaccacgccttcagcgactac

SEQ ID NO: 8605 - DNA, 426 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttatggacgccaactacctctgatagttgagtcgatacttcggcgatcaccgcttccctcataatgtttaactttgttttggcctctctactgggcctgccaagggtgcgtcctaaccggcgtctgggtcatagcccacgagtgcggccaccacgccttcagcgactac

SEQ ID NO: 8606 - DNA, 334 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaacgggcctctgggtcatagcccacgagtgcggccaccacgccttcagcgactac

SEQ ID NO: 8607 - DNA, 349 bp, Artificial
  Mutation in BnaC.FAD2.a introduced by TALE nuclease pair BnFAD2_T01
caggatccatgggtgcaggtggaagaatgcaagtgtctcctcccttcaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacagcgccctctctactgggcctgccaagggtgcgtcctaaccggcgtctgggtcatagcccgcgagtgcggccaccacgccttcagcgactac

SEQ ID NO: 8608 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctctccttctcctacctcctcttcgacatcctcgtctcctcctccctctaccacctctccacagcctacttccctctcctcccccaccctctctcctactttggcctctctactgggcctgccaagggtgcgtcctaaccggcgtctgggtcatagcccacgagtgcggccaccacgccttcagcgactac

SEQ ID NO: 8609 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccaaggctgcgtcctaacgggcctctgggtcatagcccacgagtgcggccaccacgccttcagcgactac

SEQ ID NO: 8610 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctcccctacttctctactgggcctgccaagggtgcgtcctaaccggcgtctgggtcatagcccacgagtgcggccaccacgccttcagcgactac

SEQ ID NO: 8611 - DNA, 277 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagctatcccaccgcactgtttcaaacgctcgatccctcgctctttctcctacctcatctgggacatcatcatagcctcctgcttctactacgtcgccaccacttacttccctctcctccctcaccctctctcctacttcgcgccttcagcgactac

SEQ ID NO: 8612 - DNA, 318 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcgtgccaaggctgcgtcttaacgcgcgtctgggtcatagcccacgagtgcggccaccacgccttcagcgactac

SEQ ID NO: 8613 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 8614 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacctctctactgggcctgccaaggctgcgtcctaacgggcctctgggtcatcgcccacgaatgcggccaccacgccttcagcgactac

SEQ ID NO: 8615 - DNA, 332 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggaactgccaagggtgcgtcctaaccggcgtctgggtcatagcccacgagtgcggccaccacgccttcagcgactac

SEQ ID NO: 8616 - DNA, 348 bp, Artificial
  Mutation in BnaC.FAD2.a introduced by TALE nuclease pair BnFAD2_T01
caggatccattggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 8617 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattaactctcggagacctcaagaaagcaatcacaccgcactgtttcaaacgctcgatccctcgctctttctcctacctcatctgggacatcatcatagcctcctgcttctactacgtcgccaccacttacttccctctcctccctcaccctctctcctgcctggcctctctactgggcctgccaagggtgcgtcctaaccggcgtctgggtcatagcccacgagtgcggccaccacgccttcagcgacac

SEQ ID NO: 8618 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctctttctcctacctcatctgggacatcatcatagcctcctgcttctactactccgccaccacttacttccctctcctccctcaccctctctcctacggcctctctactgggcctgccaagggtgcgtcctaaccggcgtctgggtcatagcccacgagtgcggccaccacgccttcagcgactac

SEQ ID NO: 8619 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctcctctctactgggcctgccaagggtgcgtcctaacgggcctctgggtcatagcccacgagtgcggccaccacgccttcagcgactac

SEQ ID NO: 8620 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcgccctctctactgggcctgccaagggtgcgtcctaaccggcgtctgggtcatagcccacgagtgcggccaccacgccttcagcgactac

SEQ ID NO: 8621 - DNA, 350 bp, Artificial
  Mutation in BnaC.FAD2.a introduced by TALE nuclease pair BnFAD2_T01
caggatccatgggtgcaggtggaagaatgcaagtggctcctccctccaagaagtctgaaaccgacaccatccagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcggctggttcatagcccacgagtgcggccaccacgcctgcaccgactac

SEQ ID NO: 8622 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 8623 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtcccctgcgagacaccacccttcactctcggagacctcaagaaagcaatcccacctcactgcttcaaacgctccatccctcgctccttctcctacctcctcttcgacatcctcggctcctccctctaccacctctccacagcctacttccctctcctccctcaccctctctcctactttggcctctctactgggcctgccaagggtgcgtcctaaccggcgtctgggtcatagcccacgagtgcggccaccacgccttcagcgactac

SEQ ID NO: 8624 - DNA, 356 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctgacccctctactgggcctgccaaggctgcgtcctaacgggcctctgggtcatagcccacgagtgcggccaccacgccttcagcgactac

SEQ ID NO: 8625 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaggaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 8626 - DNA, 300 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccaagggtgcgtcctaacgggcctctgggtcatagcccacgagtgcggccaccacgccttcagcgactac

SEQ ID NO: 8627 - DNA, 385 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccccgtgggcctggcacagcaccggcaacagccgctggaccgtctccagcgcctgcctggcctctctactgggcctgccaagggtgcgtcctaaccggcgtctgggtcatagcccacgagtgcggccaccacgccttcagcgactac

SEQ ID NO: 8628 - DNA, 337 bp, Artificial
  Mutation in BnaC.FAD2.a introduced by TALE nuclease pair BnFAD2_T01
caggatccattggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctactgggcctgccaagggtgcgtcctaaccggcgtctgggtcatagcccacgaatgcggccaccacgccttcagcgactac

SEQ ID NO: 8629 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcatcgactac

SEQ ID NO: 8630 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaaccggcgtctgggtcatagcccacgagtgcggccaccacgccttcagcactac

SEQ ID NO: 8631 - DNA, 413 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacccggcggatttgtcctactcaggagagcgttcaccgacaaacaacagataaaacgaaaggcccagtcggcctctctactgggcctgccaagggtgcgtcctaaccggcgtctgggtcatagcccacgagtgcggccaccacgccttcagcgactac

SEQ ID NO: 8632 - DNA, 300 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgctagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccaagggtgcgtcctaaccggcgtctgggtcatagcccacgagtgcggccaccacgccttcagcgactac

SEQ ID NO: 8633 - DNA, 348 bp, Artificial
  Mutation in BnaC.FAD2.a introduced by TALE nuclease pair BnFAD2_T01
caggatccatgggtgcaggtggaagaatgcaagtgactcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgtggccaccacgccttcagcgactac

SEQ ID NO: 8634 - DNA, 277 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacgccttcagcgactac

SEQ ID NO: 8635 - DNA, 354 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccaagggtgcgtcctaaccggcgtctgggtcatagcccacgagtgcggccaccacgccttcagcgactac

SEQ ID NO: 8636 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaaggctgcgtcctaaccggcgtctgggtcatagcccacgagtgcggccaccacgccttcagcgactac

SEQ ID NO: 8637 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctacgagacaccgcccttcactgtctgagaactcaagaaagcaatcccaccgcactgtttcaaacgctcgatccctcgctctttctcctacctcatctgggacatcatcatagcctcctgcttctactacgtcgccgccacttacttccctctcctccctcaccctctctcctactttggcctctctactgggcctgccaatggtgcgtcctaaccggcgtctgggtcatagcccacgagggcggccaccacgccatcagcgactac

SEQ ID NO: 8638 - DNA, 341 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctggcctctctactgggcctgccaagggtgcgtcctaaccggcgtctgggtcatcgcccacgaatgcggccaccacgccttcagcgactac

SEQ ID NO: 8639 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgtgtcctaaccggcgtctgggtcatagcccacgagtgcggccaccacgccatcagcgactgc

SEQ ID NO: 8640 - DNA, 318 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccaagggtgcgtcctaacgggcgtctgggtcatagcccacgagtgcggccaccacgccttcagcgactac

SEQ ID NO: 8641 - DNA, 313 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccaccattcactctcggagacctcaagaaagcaatcccacctcactgcttcaaacgctccatcccacgctccttctcctcttcgacatcatcatctcctcctcggctcctccctcaccctctctcctactttggcctctctactgggcctgccaagggtgcgtcctaacgggcgtctgggtcatagcccacgagtgcggccaccacgccttcagcgactac

SEQ ID NO: 8642 - DNA, 344 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaagggtgcgtcctaaccggcgtctgggtcatagcccacgagtgcggccaccacgccttcagcgactac

SEQ ID NO: 8643 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctggcctctctactgggcctgccaagggtgcgtcctaaccggcgtctgggtcatagcccacgagtgcggccaccacgccttcagcgactac

SEQ ID NO: 8644 - DNA, 403 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcatacctgtccgcctttctcccttcgggaagcgtggcgctttctcatagctcaggcctctctacttggcctgccaagggtgcgtcctaaccggcgtctgggtcatagcccacgagtgcggccaccacgccttcagcgactac

SEQ ID NO: 8645 - DNA, 332 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 8646 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctctccctctctcctggcctctctactgggcctgccaagggtgcgtcctaaccggcgtctgggtcatagcccacgagtgcggccaccacgccttcagcgactac

SEQ ID NO: 8647 - DNA, 318 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccaagggtgcgtcctaaccggcgtctgggtcatagcccacgagtgcggccaccacgccttcagcgactac

SEQ ID NO: 8648 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaggtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 8649 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctgccaagggtgcgtcctaaccggcgtctgggtcatagcccacgagtgcggccaccacgccttcagcgactac

SEQ ID NO: 8650 - DNA, 349 bp, Artificial
  Mutation in BnaC.FAD2.a introduced by TALE nuclease pair BnFAD2_T01
caggatccatgggtgcaggtggaagaatgcaagtgtctcctccctccacaaagcctgaaaccgacaccctcaagcgcgtaccctgcgagacaccacccttcactgtcggagaactcaagaaagcaatcccaccgcactgtttcaaacgctccatccctcgctctttctcctacctcatctgggacatcatcatcgcctcctgcttctactacgtccccaccacttacttccctctcctccctcaccctctctcctcctccggcctctctactgggcctgccaagggtgcgtcctaaccggcgtctgggtcatagcccacgagtgcggccaccacgccttcagcgactac

SEQ ID NO: 8651 - DNA, 343 bp, Artificial
  Mutation in BnaC.FAD2.a introduced by TALE nuclease pair BnFAD2_T01
caggattcatgggtgcaggtggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 8652 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcatacctcatctgggacatcatcatagcctcctgcttctactacgtcgccaccacttacttccctctcctccctcaccggtttgcgtattgccggtgcctggcctctctactgggcctgccaagggtgcgtcctaaccggcgtctgggtcatagcccacgagtgcggccaccacgccttcagcgactac

SEQ ID NO: 8653 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccaagggtgcgtcctaaccggcgtctgggtcatagcccacgagtgcggccaccacgccttcagcgactac

SEQ ID NO: 8654 - DNA, 339 bp, Artificial
  Mutation in BnaC.FAD2.a introduced by TALE nuclease pair BnFAD2_T01
caggatccatgggtgcaggtggaagaatgcaagtgtctcctccctccaacacgtctgaaaccgacaccatcaaacgcgtcccctgcgagacaccgcccttcactgtcggagaactcaagaaagcaatcccaccgcactgtttcaaacgctctatccctcgctctttctcctacctcatctggtccatcatcctagcctcctgcttctactccgtcgccaccacttacttccctctcctccctcaccctctctcccctctactgggcctgccaagggtgcgtcctaaccggcgtctgggtcatagcccacgagtgcggccaccacgccttcagcgactac

SEQ ID NO: 8655 - DNA, 349 bp, Artificial
  Mutation in BnaC.FAD2.a introduced by TALE nuclease pair BnFAD2_T01
caggatccatggatgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctcccgggcctctctactgcgcctgccaagggtgcgtcctaaccggcggatgggtcatagcccacgagtgcggccaccacgcctcagcgacac

SEQ ID NO: 8656 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctggcctctctactgggcctgccaagggtgcgtcctaaccggcgtctgggtcatagcccacgagtgcggccaccacgccttcagcgactac

SEQ ID NO: 8657 - DNA, 393 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctaacggtgcaggcgctgttgccggtgctgtgccaggcccccggcttgacccctggcctctctactgggcctgccaagggtgcgtcctaaccggcgtctgggtcatagcccacgagtgcggccaccacgccttcagcgactac

SEQ ID NO: 8658 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagacctcaagaaagcaatccaacctcactgcttcaaacgctccatcccacgctccttctcctcttcgacatcatcatctcctcctcggctcctccctctaccacctctccacagcctacttccctctcctccctcaccctctctcctacttggcctctctactgggcctgccaagggtgcgtcctaaccggcgtctgggtcatagcccacgagtgcggccaccacgccttcagcgactac

SEQ ID NO: 8659 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaacgggcctctgggtcatagcccacgagtgcggccaccacgccttcagcgactac

SEQ ID NO: 8660 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctacggggcctgccaagggtgcgtcctaaccggcgtctgggtcatagcccacgagtgcggccaccacgccttcagcgactac

SEQ ID NO: 8661 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagcctgaaactgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 8662 - DNA, 261 bp, Artificial
  Mutation in BnaC.FAD2.a introduced by TALE nuclease pair BnFAD2_T01
caggatccatgggtgcaggtggatgaatgcaagtgtctcctccctccaagaagtctgaaaccgacaccatcaagcgcgtaccctgcgagacaccgcccttcactgtcggagaactcaagaaagcaatcccaccgcactgtttcaaacgctccatcccacgctccttctcctcttcgacatcatcatctcctcctcggctcctccctctaccacctctccacagcctacttccctctcccttaccacgccttcagcgactac

SEQ ID NO: 8663 - DNA, 348 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctggcctctctacggggcctgccaagggtgcgtcctaaccggcgtctgggtcatagcccacgagtgcggccaccacgccttcagcgactac

SEQ ID NO: 8664 - DNA, 342 bp, Artificial
  Mutation in BnaC.FAD2.a introduced by TALE nuclease pair BnFAD2_T01
caggatccaagggtgcaggtggaagaatgcaagtgtctcctccctccaagaagtctgaaaccgacaccatcaagcgcgtaccctgcgagacaccgcccttcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctactctctactgggcctgccaagggtgcgtcctaaccggcgtctgggtcatagcccacgagtgcggccaccacgccttcagcgactac

SEQ ID NO: 8665 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagactgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccaagggtgcgtcctaaccggcgtctgggtcatagcccacgagtgcggccaccacgccttcagcgactac

SEQ ID NO: 8666 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttctggcctctctactgggcctgccaagggtgcgtcctaaccggcgtctgggtcatagcccacgagtgcggccaccacgccttcagcgactac

SEQ ID NO: 8667 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaactctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 8668 - DNA, 343 bp, Artificial
  Mutation in BnaC.FAD2.a introduced by TALE nuclease pair BnFAD2_T01
caggatccatgggtgcaggtggaagaatgcaagtttctcctccctccaagaagactgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcctctctactgggcgtgccaagcgtgcgtcctaaccggcgtctgggtcatagcccacgagtgctgcgaccgcgccttcagcgactac

SEQ ID NO: 8669 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 8670 - DNA, 344 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactggacctgccaagggtgcgtcctaaccggcgtctgggtcatagcccacgagtgcggccaccacgccttcagcgactac

SEQ ID NO: 8671 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaaccggcgtctgggtcatagcccacgagtgtggccaccacgccttcagcgactac

SEQ ID NO: 8672 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgccgccaccacttacttccctctcctccctcaccctctctcctcccccgccctctctactgggcctgccaagggtgcgtcctaacgggcctctgggtcatagcccacgagtgcggccaccacgccttcagcgactac

SEQ ID NO: 8673 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgggcctctctactgggcctgccaagggtgcgtcctaaccggcgtctgggtcatagcccacgagtgcggccaccacgccttcagcgactac

SEQ ID NO: 8674 - DNA, 348 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgtgcctgccaagggtgcgtcctaaccggcgtctgggtcatagcccacgagtgcggccaccacgccttcagcgactac

SEQ ID NO: 8675 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 8676 - DNA, 318 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttggcaggcctctctactgggcctgccaagggtgcgtcctaaccggcgtctgggtcatagcccacgagtgcggccaccacgccttcagcgactac

SEQ ID NO: 8677 - DNA, 348 bp, Artificial
  Mutation in BnaC.FAD2.a introduced by TALE nuclease pair BnFAD2_T01
caggatccatgggtgcaggtggcagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttggcctctctactgggcctgccaagggtgcgtcctaaccggcgtctgggtcatagcccacgagtgcggccaccacgccttcagcgactac

SEQ ID NO: 8678 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaacctacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 8679 - DNA, 438 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttaatgtttaactttgttttagggcgactgccctgctgcgtaacatcgttgctggacagcatcgatatcgccgatctacgcacgctcgacctggcctctctactgggcctgccaagggggcgtcctaaccggcgtctgggtcatagcccacgagtgcggccaccacgccttcagcgactac

SEQ ID NO: 8680 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggcctgccaagggtgcgtcctaaccggcgtctgggtcatagcccacgagtgcggccaccacgccttcagcgactac

SEQ ID NO: 8681 - DNA, 344 bp, Artificial
  Mutation in BnaC.FAD2.a introduced by TALE nuclease pair BnFAD2_T01
caggatccatgggtgcaggtggaagaatgcaagtctctcctccctccagctcccccggaaccgacaccatcaagcgcgtaccctgcgagacaccgcccttcactgtcggagaactcaagaaagcaatcccaccgcactgtttcaaacgctcgatccctcgctctttctcctacctcatccgggacatcatcatagcctcctgcttctactacgtcgccaccacttacttccctctcctccctccccctctcccctagcctctctactgggcctgccaagggtgcgtcctaaccggcgtctgggtcatagcccacgagtgcggccaccacgccttcagcgactac

SEQ ID NO: 8682 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctatttctcctacctcatctgggacatcatcatagcctcctgcttctactacgtcgccaccacttacttccctctcctccctcaccctctctcctgggcctgccaagggtgcgtcctaaccggcgtctgggtcatagcccacgagtgcggccaccacgccttcagcgactac

SEQ ID NO: 8683 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttggcctctctactgggcctgccaagggtgcgtcctaacgggcctctgggtcatagcccacgagtgcggccaccacgccttcagcgactac

SEQ ID NO: 8684 - DNA, 351 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcctggcctctctactgggcctgccaagggtgcgtcctaaccggcgtctgggtcatcgcccacgaatgcggccaccacgccttcagcgactac

SEQ ID NO: 8685 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcagcctctctactgggcctgccaagggtgcgtcctaaccggcgtctgggtcatagcccacgagtgcggccaccacgccttcagcgactac

SEQ ID NO: 8686 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 8687 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggccggccaagggtgcggcctaaccggcgtcggggtcattggccacgagtgcggccaccacgcctttagcgactac

SEQ ID NO: 8688 - DNA, 348 bp, Artificial
  Mutation in BnaC.FAD2.a introduced by TALE nuclease pair BnFAD2_T01
caggatccatgggtgcaggtggaagaatgcaagagtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 8689 - DNA, 348 bp, Artificial
  Mutation in BnaC.FAD2.a introduced by TALE nuclease pair BnFAD2_T01
caaggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 8690 - DNA, 346 bp, Artificial
  Mutation in BnaC.FAD2.a introduced by TALE nuclease pair BnFAD2_T01
caggatccatggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaacgggcctctgggtcatagcccacgagtgcggccaccacgccttcagcgactac

SEQ ID NO: 8691 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagcgtgcgtcctaaccggcgtctgggtcatagcccacgagtgcggccaccacgccttcagcgactac

SEQ ID NO: 8692 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcggctctctactgggcctgccaagggtgcgtcctaaccggcgtctgggtcatagcccacgagtgcggccaccacgccttcagcgactac

SEQ ID NO: 8693 - DNA, 346 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcctctctactgggcctgccaagggtgcgtcctaaccggcgtctgggtcatagcccacgagtgcggccaccacgccttcagcgactac

SEQ ID NO: 8694 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaacgggcctctgggtcatagcccacgagtgcggccaccacgccttcagcgactac

SEQ ID NO: 8695 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctgaccggcgtctgggtcatagcccacgagtgcggccaccacgccttcagcgactac

SEQ ID NO: 8696 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctggcctctctactgggcctgccaagggtgcgtcctaaccggcgtctgggtcatagcccacgagtgcggccaccacgccttcagcgactac

SEQ ID NO: 8697 - DNA, 418 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttggaaacttcggcttcccctggagagagcgagattctccgcgctgtagaagtcaccattgttgtgcacgacggcctctctactgggcctgccaagggtgcgtcctaaccggcgtctgggtcatagcccacgagtgcggccaccacgccttcagcgactac

SEQ ID NO: 8698 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctaccaagggtgcgtcctaaccggcgtctgggtcatagcccacgagtgcggccaccacgcctacagcgactac

SEQ ID NO: 8699 - DNA, 312 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccacactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 8700 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaaggctgcgtcctaacgggcctctgggtcatagcccacgagtgcggccaccacgccttcagcgactac

SEQ ID NO: 8701 - DNA, 346 bp, Artificial
  Mutation in BnaC.FAD2.a introduced by TALE nuclease pair BnFAD2_T01
caggatctgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaacgggcctctgggtcatagcccacgagtgcggccaccacgccttcagcgactac

SEQ ID NO: 8702 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtatcctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccaagggtgcgtcctaaccggcgtctgggtcatagcccacgagtgcggccaccacgccttcagcgactac

SEQ ID NO: 8703 - DNA, 345 bp, Artificial
  Mutation in BnaC.FAD2.a introduced by TALE nuclease pair BnFAD2_T01
caggatccatgtgtgcaggtggaagaatgcaagtgtctcctccctccaagaagtctgaaaccgacaccatcaagcgcataccctgcgagacaccgcccttcactgtcggagaactcaagaaagcaatcccacctcactgtttcaaacgctcgatccctcgctctttctcctacctcatctgggacatcatcatagcctcctgcttctactacgtcgccaccacttacttccctctcctccctcaccctctctccttggcctctctactgggcctgccaagggtgcgtcctaaccggcgtctgggtcatagcccacgagtgcggccaccacgccttcagcgactac

SEQ ID NO: 8704 - DNA, 419 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcaggcgctgttgctggtgctgtgccaggcccacggcttgaccccccagcaggtggtggccatcgccagatggcctctctactgggcctgccaagggtgcgtcctaaccggcgtctgggtcatagcccacgagtgcggccaccacgccttcagcgactac

SEQ ID NO: 8705 - DNA, 318 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccaagggtgcgtcctaaccggcgtctgggtcatagcccacgagtgcggccaccacgccttcagcgactac

SEQ ID NO: 8706 - DNA, 351 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttgctggcctctctactgggcctgccaagggtgcgtcctaaccggcgtctgggtcatagcccacgagtgcggccaccacgccttcagcgactac

SEQ ID NO: 8707 - DNA, 334 bp, Artificial
  Mutation in BnaC.FAD2.a introduced by TALE nuclease pair BnFAD2_T01
caggatccatgggtgcagggggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactcggcctgccaagggtgcgtcctaaccggcgtctggttcatagcccacgagtgcggccaccacgccttcagcgactac

SEQ ID NO: 8708 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccccccctctcccttgcctctggcccctctactgggcctgccaaggctgcgtcctaacgggcctctgggtcatcgcccacgaatgcggccaccacgccttcagcgactac

SEQ ID NO: 8709 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctactcctctctactgggcctgccaggggtgcgtcctaaccggcgtctgggtcatagtccacgagtgcggccaccacgccttcagcgactac

SEQ ID NO: 8710 - DNA, 357 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccccccgcctggcctctctactgggcctgccaagggtgcgtcctaaccggcgtctgggtcatagcccacgagtgcggccaccacgccttcagcgactac

SEQ ID NO: 8711 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctccaccctcaccctctctcctacttcgcctctctactgggcctgccaagggtgcgtcctaaccggcgtctgggtcatagcccacgagtgcggccaccacgccttcagcgactac

SEQ ID NO: 8712 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaaggctgcgtcctaacgggcctctgggtcatagcccacgagtgcggccaccacgccttcagcgactac

SEQ ID NO: 8713 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgctgccaagggtgcgtcctaaccggcgtctgggtcatagcccacgagtgcggccaccacgccttcagcgactac

SEQ ID NO: 8714 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgcctcagcgactac

SEQ ID NO: 8715 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 8716 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 8717 - DNA, 358 bp, Artificial
  Mutation in BnaC.FAD2.a introduced by TALE nuclease pair BnFAD2_T01
catgatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctcgcctggcctctctactgggcctgccaagggtgcgtcctaaccggcgtctgggtcatagcccacgagtgcggccaccacgccttcagcgactac

SEQ ID NO: 8718 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcagcctctctactgggcctgccaagggtgcgtcctaacgggcctctgggtcatcgcccacgaatgcggccaccacgccttcagcgactac

SEQ ID NO: 8719 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactcgcctctctactgggcctgccaagggtgcgtcctaaccggcgtctgggtcatagcccacgagtgcggccaccacgccttcagcgactac

SEQ ID NO: 8720 - DNA, 312 bp, Artificial
  Mutation in BnaC.FAD2.a introduced by TALE nuclease pair BnFAD2_T01
caggatccatgggtgcaggtggaagaatgcaagtctctcctccctccagctaccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 8721 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 8722 - DNA, 438 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccagctgggccttgtagttgcccttgaagtggccggacacgaacaggaacttgaactcggtcacgctggaggggtacaccttccacctggcctctctactgggcctgccaagggtgcgtcctaaccggcgtctgggtcatagcccacgaatgcggccaccacgccttcagcgactac

SEQ ID NO: 8723 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctagatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 8724 - DNA, 350 bp, Artificial
  Mutation in BnaC.FAD2.a introduced by TALE nuclease pair BnFAD2_T01
caggatccatgggtgcaggtggaagaatgcaagtgtctcctccctacaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcaccaccacttacttctctctcctccctcaccctctctcctgcagccaggcctctctacagggcctgccaagggtgcgtcctagccggcgtctgggtcatagcccacgagtgcggccaccacgcttcagcgactac

SEQ ID NO: 8725 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaggcctctctactgggcctgccaaggctgcgtcctaacgggcctctgggtcatcgcccacgaatgcggccaccacgccttcagcgactac

SEQ ID NO: 8726 - DNA, 340 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccaagggtgcgtcctaaccggcgtctgggtcatagcccacgagtgcggccaccacgccttcagcgactac

SEQ ID NO: 8727 - DNA, 326 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatctcctcctcggctcctccctctaccacctctccacagcctacttcgcctctctactgggcctgccaagggtgcgtcctaaccggcgtctgggtcatagcccacgagtgcggccaccacgccttcagcaactac

SEQ ID NO: 8728 - DNA, 350 bp, Artificial
  Mutation in BnaC.FAD2.a introduced by TALE nuclease pair BnFAD2_T01
caggatccatgggtgcatgtggaagaatgcaagtgtctcctccctccaagaagactgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 8729 - DNA, 344 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaagggtgcgtcctaaccggcgtctgggtcatagcccacgagtgcggccaccacgccttcagcgactac

SEQ ID NO: 8730 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccctcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaaccggcgtctgggtcatagcccacgagtgcggccaccacgccttcagcgactac

SEQ ID NO: 8731 - DNA, 346 bp, Artificial
  Mutation in BnaC.FAD2.a introduced by TALE nuclease pair BnFAD2_T01
caggatccatgggtgcacgtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtacggccaccacgccttcagcgactac

SEQ ID NO: 8732 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaagggtgcgtcctaaccggcgtctgggtcatagcccacgagtgcggccaccacgccttcagcgactac

SEQ ID NO: 8733 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccggcctctctactgggcctgccaagggtgcgtcctaaccggcgtctgggtcatagcccacgagtgcggccaccacgccttcagcgactac

SEQ ID NO: 8734 - DNA, 346 bp, Artificial
  Mutation in BnaC.FAD2.a introduced by TALE nuclease pair BnFAD2_T01
caggatccatgggtgcaggtggaagaatgcaagtgtatactccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgagtgcggccaccacgccttcagcgactac

SEQ ID NO: 8735 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtggcctctctactgggcctgccaagggtgcgtcctaaccggcgtctgggtcatagcccacgagtgcggccaccacgcctgcagcgactac

SEQ ID NO: 8736 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtcccctgcgagacaccgcccttcactgtcggagaactcaagaaagcaatcccaccgcactgtttcaaacgctcgatccctcgctctttctcctacctcatctgggacatcatcatagcctcctgcttctactatgtcgccaccacttacttccctctcctccctcaccggtttgcgtattgccggtgcctggcctctctactgggcctgccaagggtgcgtcctaaccggcgtctgggtcatagcccacgagtgcggccaccacgccttcagcgactac

SEQ ID NO: 8737 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaacggcgtctgggtcatagcccacgagtgcggccaccacgccttcagcgactac

SEQ ID NO: 8738 - DNA, 342 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaagggtgcgtcctaaccggcgtctgggtcatagcccacgagtgcggccaccacgccttcagcgactac

SEQ ID NO: 8739 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctctctactgggcctgccaagggtgcgtcctaaccggcgtctgggtcatagcccacgagtgcggccaccacgccttcagcgactac

SEQ ID NO: 8740 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 8741 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccgccacgccttcagcgactac

SEQ ID NO: 8742 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctagctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 8743 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcctctgggtcatcgcccacgaatgcggccaccacgccttcagcgactac

SEQ ID NO: 8744 - DNA, 349 bp, Artificial
  Mutation in BnaC.FAD2.a introduced by TALE nuclease pair BnFAD2_T01
cagggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 8745 - DNA, 347 bp, Artificial
  Mutation in BnaC.FAD2.a introduced by TALE nuclease pair BnFAD2_T01
caggaaccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 8746 - DNA, 331 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaaccggcgtctgggtcatagcccacgagtgcggccaccacgccttcagcgacta

SEQ ID NO: 8747 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaaacaatcccaccgcactgtttcaaacgctcgatccctcgctctttctcctacctcatctgggacatcatcatagcctcctgcttctactacgtcgccaccacttacttccctctcctccctcaccctctctccgcctggcctctctactgggcctgccaagggtgcgtcctaaccggcgtctgggtcatagcccacgagtgcggccaccacgccttcagcgactac

SEQ ID NO: 8748 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctacgtctggcctctctactgggcctgccaagggtgcgtcctaaccggcgtctgggtcatagcccacgagtgcggccaccacgccttcagcgactac

SEQ ID NO: 8749 - DNA, 348 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 8750 - DNA, 395 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcaaactcttcctggctagcggtacgcgtattaattgcgtcctggcctctctactgggcctgccaagggtgcgtcctaacgggcctctgggtcatagcccacgagtgcggccaccacgccttcagcgactac

SEQ ID NO: 8751 - DNA, 320 bp, Artificial
  Mutation in BnaC.FAD2.a introduced by TALE nuclease pair BnFAD2_T01
caggatccatggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaaccggcgtctgggtcatagcccacgagtgcggccaccacgccttcagcgactac

SEQ ID NO: 8752 - DNA, 312 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 8753 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcccgcctctctactgggcctgccaagggtgcgtcctaacgggcctctgggtcatagcccacgagtgcggccaccacgccttcagcgactac

SEQ ID NO: 8754 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccaaggctgcgtcctaaccggcgtctgggtcatagcccacgagtgcggccaccacgccttcagcgactac

SEQ ID NO: 8755 - DNA, 339 bp, Artificial
  Mutation in BnaC.FAD2.a introduced by TALE nuclease pair BnFAD2_T01
caggatccatgggtgcatgtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccaagggtgcgtcctaaccggcgtctgggtcatagcccacgagtgcggccaccacgccttcagcgactac

SEQ ID NO: 8756 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaaggctgcgtcctaacgggcctctgggtcatcgcccacgaatgcggccaccacgccttcagcgactac

SEQ ID NO: 8757 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccatgcgagacaccaccattcactctcggagacctcaagaaagcaatcccaccgcactgtttcaaacgctcgatccctcgctctttctcctacctcatctgggacgtcatcatagcctcctgcttctactacgtcgcccccacttccttccctctcctccctctccctctctcctcctttggcctctctactgggcctgccaagggtgcgtcctaaccggcgtctgggtcatagcccacgagtgcggccaccacgccttcagcgactac

SEQ ID NO: 8758 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 8759 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctccatccctcgctctttctcctacctcatctgggacatcatcatagcctcctgcttctactaccccgccaccacttacttccctctcctccctcatcccctcccccgcatggcctctctactgggcctgccaagggtgcgtcctaaccggcgtctgggtcatagcccacgagtgcggccaccacgccttcagcgactac

SEQ ID NO: 8760 - DNA, 323 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacgtcatcatagcctcctgcttctactacgtcgccaccacttacttccctcgagccacccactgggcctgccaagggtgcgtcctaaccggcgtctgggtcatagcccacgagggcggccaccacgccttcagcgactac

SEQ ID NO: 8761 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctcctctctactgggcctgccaagggttcgtcctaaccggcgtctgggtcatagcccacgagtgcggccaccacgccttcagcgactac

SEQ ID NO: 8762 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgaggcctctctactgggcctgccaagggtgcgtcctaaccggcgtctgggtcatagcccacgagtgcggccaccacgccttcagcgactac

SEQ ID NO: 8763 - DNA, 335 bp, Artificial
  Mutation in BnaC.FAD2.a introduced by TALE nuclease pair BnFAD2_T01
caggatccatgggtgcaggtggaagaatgcaagtgactcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttagcctgccaagggtgcgtcctaaccggcgtctgggtcatagcccacgagttcggccaccacgccttcagcgactac

SEQ ID NO: 8764 - DNA, 344 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgccccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactggacctgccaagcgtgcgtcctaaccggcgtctgggtcatagcccacgagtgcggccaccacgccttcagcgactac

SEQ ID NO: 8765 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccacctcgccttcagcgactac

SEQ ID NO: 8766 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaagggtgcgtcctaaccggcgtctgggtcatagcccactagtgcggccaccgcgccttcagcgactac

SEQ ID NO: 8767 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccatgagtgcggccaccacgccttcagcgactac

SEQ ID NO: 8768 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctaccgggcctgccaaggctgcgtcctaacgggcctctgggtcatagcccacgagttcggccaccacgccttcagcgactac

SEQ ID NO: 8769 - DNA, 344 bp, Artificial
  Mutation in BnaC.FAD2.a introduced by TALE nuclease pair BnFAD2_T01
caggatccatgggtgcaggtggaagaatgcaagtgtctcctctctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 8770 - DNA, 349 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccgtcaagcgcgtaccctgcgagacaccgcccttcactgtcggagaactcaagaaaacaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggctgtgtcctaacgggcctctgggtcatagcccacgagtgcggccaccacgccttcagcgactac

SEQ ID NO: 8771 - DNA, 405 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcaatgcactgacgggtgccccgctcaacttgaccccccagcaggtggtggccatcggcctctctactgggcctgccaagggtgcgtcctaaccggcgtctgggtcatagcccacgagtgcggccaccacgccttcagcgactac

SEQ ID NO: 8772 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 8773 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 8774 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccacctggcctctctactgggcctgccaagggtgcgtcctaaccggcgtctgggtcatagcccacgagtgcggccaccacgccttcagcgactac

SEQ ID NO: 8775 - DNA, 350 bp, Artificial
  Mutation in BnaC.FAD2.a introduced by TALE nuclease pair BnFAD2_T01
caggatccatgggtgcagggggaagaatgcaagtgtctcctccctccaagaagtctgaaaccgacaccatcaagcgcgtaccctgcgagacaccgcccttcactgtcggagaactcaagaaagcaaacccaccgcactgtttcaaacgctcgatccctcgctctttctcctacctcatctgggacatcatcatagcctcctgcttctactacgtcgccaccacttacttccctctcctccctcaccctctctcctactgctggcctctctactgggcctgccaagggtgcttcctaaccggcgtctggttcatagcccgcgagtgcggccaccacgccttcagcgactac

SEQ ID NO: 8776 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttcctctctactgggcctgccaagggtgcgtcctaaccggcgtctgggtcatagcccacgagtgcggccaccacgccttcagcgactac

SEQ ID NO: 8777 - DNA, 348 bp, Artificial
  Mutation in BnaC.FAD2.a introduced by TALE nuclease pair BnFAD2_T01
caggatccatgggtgcaggtagaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 8778 - DNA, 347 bp, Artificial
  Mutation in BnaC.FAD2.a introduced by TALE nuclease pair BnFAD2_T01
caggatccatgggtgcaggtggaagaatgcaattgtctcctccctccaataagtctgaaaccgacaccatcacgcgcgtaccctgcgagacaccgcccttcactgtcggagaactcaagaaagcaatcccacctcactgtttcaaacgctcgatccctcgctctttctcctacctcatctgggacatcatcatagcctcctgtttctactacgtcgccaccacttacttccctctcctccctcaccctctctcccacttgcctctctactgggcctgccaagggtgcgtcctaaccggagtctgggtcatagcccacgagggcggccaccacgccttcagcgactac

SEQ ID NO: 8779 - DNA, 424 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctccagcgcctgcttgccgccatcgtggctggcgatggccaccacctgctccggggtcaagccgtgggcctggcatggcctctctactgggcctgccaagggtgcgtcctaaccggcgtctgggtcatagcccacgagtgcggccaccacgccttcagcgactac

SEQ ID NO: 8780 - DNA, 324 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctggcacatcatcatagcctcctgcttctactacgtcgcccccacttacttccctctcctccctcgccctctcttgccaagggtgcgtcctaaccggcgtctgggtcatagcccacgagtgcggccaccacgccttcagcgactac

SEQ ID NO: 8781 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 8782 - DNA, 385 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccgtgggcctgccacagcaccggcaacagccgctggaccgtctccagcgcctgcctggcctctctactgggcctgccaagggtgcgtcctaaccggcgtctgggtcatagcccacgagtgcggccaccacgccttcagcgactac

SEQ ID NO: 8783 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccaactccgcccgcctggcctctctactgggcctgccaagggtgcgtcctaaccggcgtctgggtcatagcccacgagtgcggccaccacgccttcagcgactac

SEQ ID NO: 8784 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgtggccaccacgccttcagcgactac

SEQ ID NO: 8785 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctccatccctcgctctttctcctacctcatctgggacatcatcatagcctcctgcttctactacgtccccaccactcacttccctctcctccctcaccctctcccctacttggcctctctactgggcctgccaagggtgcgtcctaacgggcctctgggtcatcgcccacgagtgcggccaccacgccttcagcgactac

SEQ ID NO: 8786 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgaatgcggccaccacgccttcagcgactac

SEQ ID NO: 8787 - DNA, 351 bp, Artificial
  Mutation in BnaC.FAD2.a introduced by TALE nuclease pair BnFAD2_T01
caggatccatgggtgcatgtggaagaatgcaagtgtctcctccctccaagaagtctgaaaccgacaccatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaaccggcgtctgggtcatagcccacgagtgcggccaccacgccttcagcgactac

SEQ ID NO: 8788 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 8789 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaacgggcctctgggtcatcgcccacgaatgcggccaccacgccttcagcgactac

SEQ ID NO: 8790 - DNA, 321 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctggtacatcatcatagcctcctgcttctactacgtcgccaccacttacttccctctcctccctcaccctctctcaagggtgcgtcctaaccggcgtctgggtcatagcccacgagtgcggccaccacgccttcagcgactac

SEQ ID NO: 8791 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttacctctctactgggcctgccaaggctgcgtcataacgggcctctgggtcatagcccacgagtgcggccaccacgccttcagcgactac

SEQ ID NO: 8792 - DNA, 342 bp, Artificial
  Mutation in BnaC.FAD2.a introduced by TALE nuclease pair BnFAD2_T01
caggatccatgagtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgtctctctactgggcctgccaagggtgcgtcctaaccggcgtctgggtcatagcccacgagtgcggccaccacgccttcagcgactac

SEQ ID NO: 8793 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctcccctaggcctctctactgggcctgccaaggctgcgtcctaacgggcctctgggtcatagcccacgagtgcggccaccacgccttcagcgactac

SEQ ID NO: 8794 - DNA, 365 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacctacttccctctcctccctcaccctctctcctacttggccaccacctgctggggggtcaagccgtgggcctgccaagggtgcgtcctaaccggcgtctgggtcatagcccacgagtgcggccaccacgccttcagcgactac

SEQ ID NO: 8795 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctacttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 8796 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaacgggcctctgggtcatagcccacgagtgcggccaccacgccttcagcgactac

SEQ ID NO: 8797 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctatactgggcctgccaagggtgcgccctaaccggcgtctgggtcatagcccacgagtgcggccaccacgccttcagcgactac

SEQ ID NO: 8798 - DNA, 321 bp, Artificial
  Mutation in BnaC.FAD2.a introduced by TALE nuclease pair BnFAD2_T01
caggatccatgggtgcaggtgcaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaaccggcgtctgggtcatagcccacgagtgcggccaccacgccttcagcgactac

SEQ ID NO: 8799 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttaagcgactac

SEQ ID NO: 8800 - DNA, 318 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccaaggctgcgtcctaacgggcctctgggtcatagcccacgagtgcggccaccacgccttcagcgactac

SEQ ID NO: 8801 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctggcacatcatcatagcctcctgcttctactacgtcgccaccacttacttccctctcctccctcaccctctctcctaccgctggcctctctactgggcctgccaagggtgcgtccgaaccggcgtcggggtcatagcccacgagtgcggccaccacgccttcagcgactac

SEQ ID NO: 8802 - DNA, 339 bp, Artificial
  Mutation in BnaC.FAD2.a introduced by TALE nuclease pair BnFAD2_T01
caggatccatgggtgcaggtggaagaatgcaagtgactcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgggtcatagcccacgagttcggccaccacgccttcaacgactac

SEQ ID NO: 8803 - DNA, 318 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcatacctcatctgggacatcatcatagcctcctgcttctactacgtcgccaccacttggcaggcctctctactgggcctgccaagggtgcgtcctaaccggcgtctgggtcatagcccacgagtgcggccaccacgccttcagcgactac

SEQ ID NO: 8804 - DNA, 312 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctcttcgacatcatcatctcctcctcggctcctccctcaccctctctcctacttggcctctctactgggcctgccaagggtgcgtcctaaccggcgtctgggtcatagcccacgagtgcggccaccacgccttcagcgactac

SEQ ID NO: 8805 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttcctctctactgggcctgccaagggtgcgtcctaaccggcgtcggggtcatagcccacgagtgcggccaccacgccttcagcgactaa

SEQ ID NO: 8806 - DNA, 351 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgggcctctctactgggcctgccaagggtgcgtcctaaccggcgtctgggtcatagcccacgagtgcggccaccacgccttcagcgactac

SEQ ID NO: 8807 - DNA, 473 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcgaacgctcgatccctcgctctttctcctacctcatctgggacatcatcatagcctcctgcttctactacgtcgccaccacttacttccctctcctccctcaccctctctcctacttccagtcgcatattccctctcaatccaaataatctgcaccggatctcgccctatcagccgttcccagctggtgaagtccgagctggaggagaagaataatgggggcaagcaggcgctggagtccctggcctctctactgggcctgccaaggctgcgtcctaacgggcctctgggtcatagcccacgagtgcggccaccacgccttcagcgactac

SEQ ID NO: 8808 - DNA, 405 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcgcaatgcactgacgggtgccccgctcaacttgaccccccagcaggtggtggccatcggcctctctactgggcctgccaagggtgcgtcctaaccgtcgtctgggtcatagcccacgattgcggccaccacgccttcagcgactac

SEQ ID NO: 8809 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagcccgaaaccgacaccatcaagcgcgtaccctgcgagacaccccccttcactgtcggagaactcaagaaagcaatcccaccgcactgtttcaaacgctcgatccctcgctctttctcctacctcatctgggacatcatcatagcctcctgcctctactacgtcgccaccacttacttccctctcctccctcaccctctcccccaggcccctctactgggcctgccaagggtgcgtcctaaccggcgtctgggtcatcgcccacgagtgcggccaccacgccttcagcgactac

SEQ ID NO: 8810 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactactgggcctgccaagggtgcgtcctaacgggcctctgggtcatcgcccacgaatgcggccaccacgccttcagcgactac

SEQ ID NO: 8811 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgaatgcggccaccacgccttcagcgactac

SEQ ID NO: 8812 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactaggcctgccaagggtgcgtcctaaccggcgtctgggtcatagcccacgagtgcggccaccacgccttcagcgactac

SEQ ID NO: 8813 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactactgggcctgccaagggtgcgtcctaaccggcgtctgggtcatagcccacgagtgcggccaccacgccatcagcgactac

SEQ ID NO: 8814 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaagggtgcgtcctaaccggcgtctgggtcatagcccacgagtgcggccaccacgccttcagcgactac

SEQ ID NO: 8815 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaaggctgcgtcctaacgggcctctgggtcagcgcccacgaatgcggccaccacgccttcagcgactac

SEQ ID NO: 8816 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttcgcctggcctctctactgggcctgccaaggctgcgtcctaacgggcctctgggtcatcgcccacgaatgcggccaccacgccttcagcgactac

SEQ ID NO: 8817 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctggcccctctactgggcctgccaaggctgcgtcctaacgggcctctgggtcatcgcccacgaatgcggccaccacgccttcagcgactac

SEQ ID NO: 8818 - DNA, 318 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctctatccctcgctctttctcctacctcatctgggacatcatcatagcctcctgcttctactacgtcgccaccacttggcaggcctctctactgggcctgccaagggtgcgtcctaaccggcgtctgggtcatagcccacgagtgcggccaccacgccttcagcgactac

SEQ ID NO: 8819 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 8820 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgagtgcggccaccacgccttcagcgactac

SEQ ID NO: 8821 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctggcccctctactgggcctgccaaggctgcgtcctaacgggcctctgggtcatcgcccacgaatgcggccaccacgccttcagcgactac

SEQ ID NO: 8822 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaacgggcctctgggtcatagcccacgagtgcggccaccacgccatcagcaactac

SEQ ID NO: 8823 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggtgcgtcctaaccggcgtctggggcatagcccacgagtgcggccaccacgccttcagcgactac

SEQ ID NO: 8824 - DNA, 345 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctaggcctctctactgggcctgccaagggtgcgtcctaaccggcgtctgggtcatagcccacgagtgcggccaccacgccttcagcgactac

SEQ ID NO: 8825 - DNA, 321 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaaacaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaaccggcgtctgggtcatagcccacgagtgcggccaccacgccttcagcgactac

SEQ ID NO: 8826 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccatccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctggcctctctactgggcctgccaagggtgcgtcctaaccggcgtctgggtcatagcccacgagtgcggccaccacgccttcagcgactac

SEQ ID NO: 8827 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccccctctctactgggcctgccaagggtgcgtcctaaccggcgtctgggtcatagcccacgagtgcggccaccacgccttcagcgactac

SEQ ID NO: 8828 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaaggctgcgtcctaacgggcctctgggtcatcgcccacgagtgcggccaccacgccttcagcgactac

SEQ ID NO: 8829 - DNA, 340 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccaagggtgcgtcctaaccggcgtctgggtcatagcccacgagtgcggccaccacgccttcagcgactac

SEQ ID NO: 8830 - DNA, 345 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaaccggcgtctgggtcatagcccacgagtgcggccaccacgccttcagcgactac

SEQ ID NO: 8831 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcgaccaccacgccttcagcgactac

SEQ ID NO: 8832 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctccctcaccctctctcctactttggcctctctactgggcctgccaaggctgcgtcctaaccggcgtctgggtcatagcccacgagtgcggccaccacgccttcagcgactac

SEQ ID NO: 8833 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtctgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 8834 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccgcaccctctctcctacttggcctctctactgggcctgccaagggtgcgtcctaacgggcctctgggtcatcgcccacgaatgcggccaccacgccttcagcgactac

SEQ ID NO: 8835 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 8836 - DNA, 350 bp, Artificial
  Mutation in BnaC.FAD2.a introduced by TALE nuclease pair BnFAD2_T01
caggatccattggtgcaggtggaagaatgcaagtgtctcctccctccaagaagtctgaaaccgacaccatcaagcgcgtaccctgcgagacaccgcccttcactctcggagacctcaagaaagcaatcccacctcactgtttcaaacgctcgatccctcgctctttctcctacctcatctgggacatcatcatagcctcctgcttctactacgtcgccaccacttacttccctctcctccctccccctctctcctacgtttggcctctctactgggcctgccaagggtgcgtcctaaccggcgtctgggtcatagcccacgagtgcggccaccacgccttcagcgactac

SEQ ID NO: 8837 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaacgggcctctgggtcatcgcccacgaatgcggccaccacgccttcagcgactac

SEQ ID NO: 8838 - DNA, 349 bp, Artificial
  Mutation in BnaC.FAD2.a introduced by TALE nuclease pair BnFAD2_T01
caggatccatgggtgcaggtggaagaatgcaagtctatcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaagggtgcgtcctaaccggcgtctgggtcatagcccacgagtgcggccaccacgccttcagcgactac

SEQ ID NO: 8839 - DNA, 339 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgggtcatagcccacgagtgcggccaccacgccttcagcgactac

SEQ ID NO: 8840 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagagtgcgtcctaaccggcgtctgggtcatagcccacgagtgcggccaccacgccttcagcgactac

SEQ ID NO: 8841 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcctgccaagggtgcgtcctaaccggcgtctgggtcatcgcccacgaatgcggccaccacgccttcagcgactac

SEQ ID NO: 8842 - DNA, 344 bp, Artificial
  Mutation in BnaC.FAD2.a introduced by TALE nuclease pair BnFAD2_T01
caggatccatgggtgcaggtggaagaatgcaagtgtctccttcctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 8843 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccaccaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 8844 - DNA, 342 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaagggtgcgtcctaaccggcgtctgggtcatagcccacgagtgcggccaccacgccttcagcgactac

SEQ ID NO: 8845 - DNA, 441 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccggtgcccatcgccccccacgatggcggcaagccggcgctggagccggtcccgcggctgtcgccggtgctgtgcccggcccaccgcttgacccctggcctctctactgggcctgccaagggtgcgtcctaaccggcgtctgggtcatagcccacgagtgcggccaccacgccttcagcgactac

SEQ ID NO: 8846 - DNA, 323 bp, Artificial
  Mutation in BnaC.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctcgagccacccactgggcctgccaagggtgcgtcctaaccggcgtctgggtcatagcccacgagtgcggccaccacgccttcagcgactac

SEQ ID NO: 8847 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaggcctctctactgggcctgccaagggtgcgtcctaacgggcctctgggtcatcgcccacgaatgcggccaccacgccttcagcgactac

SEQ ID NO: 8848 - DNA, 324 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcttgccaagagtgcgtcctaaccggcgtctgggtcatagcccacgagtgcggccaccacgccttcagcgactac

SEQ ID NO: 8849 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccagcctggcctctctactgggcctgccaagggtgcgtccgaaccggcgtcggggtcatagcccacgagtgcggccaccacgccttcagcgactac

SEQ ID NO: 8850 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccaagggtgcgtcctaacgggcctctgggtcatagcccacgagtgcggccaccacgccttcagcgactac

SEQ ID NO: 8851 - DNA, 340 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 8852 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagtgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgggcctctctactgggcctgccaagggtgcgtcctaaccggcgtctgggtcatagcccacgagtgcggccaccacgccttcagcgactac

SEQ ID NO: 8853 - DNA, 349 bp, Artificial
  Mutation in BnaC.FAD2.a introduced by TALE nuclease pair BnFAD2_T01
caggatccatgggtgcaggtggaagaatgcaagtgtctcctcccccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 8854 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctccttcggctctctactgggcctgccaagggtgcgtcctaaccggcgtctgggtcatagcccacgagtgcggccaccacgccttcagcgactac

SEQ ID NO: 8855 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaaggctgcgtcctaacgggcctctgggtcatagcccacgagtgcggccaccacgccttcagcgactac

SEQ ID NO: 8856 - DNA, 424 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactcctccagcgcctccttgccgccatcgtggctggcgatggccaccacctgctccggggtcaagccgtgggcctggcatggcctctctactgggcctgccaagggtgcgtcctaaccggcgtctgggtcatagcccacgagtgcggccaccacgccttcagcgactac

SEQ ID NO: 8857 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttcctctctacggggcctgccaagggtgcgtcctaaccggcgtctgggtcatagcccacgagtgcggccaccacgccttcagcgactac

SEQ ID NO: 8858 - DNA, 323 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacctctctcgccaagggtgcgtcctaaccggcgtctgggtcatagcccacgagtgcggccaccacgccttcagcgactac

SEQ ID NO: 8859 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctccttggcctctctactgggcctgccaagggtgcgtcctaaccggcgtctgggtcatagcccacgagtgcggccaccacgccttcagcgactac

SEQ ID NO: 8860 - DNA, 337 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctaccgggcctgccaagggtgcgtcctaaccggcgtctgggtcagagcccacgagtgcggccaccgcgccttcagcgactac

SEQ ID NO: 8861 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttcgccgcctggcctctctactgggcctgccaagggtgcgtcctaaccggcgtctgggtcatagcccacgagtgcggccaccacgccttcagcgactac

SEQ ID NO: 8862 - DNA, 354 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccaagggtgcgtcctaaccggcgtctgggtcatagcccacgagtgcggccaccacgccttcagcgactac

SEQ ID NO: 8863 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctcttcgcctggcctctctactgggcctgccaagggtgcgtcctaaccggcgtctgggtcatagcccacgagtgcggccaccacgccttcagcgactac

SEQ ID NO: 8864 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 8865 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgtcaaggctgcgtcctaacgggcctctgggtcatagcccacgagtgcggccaccacgccttcagcgactac

SEQ ID NO: 8866 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgtcaagggtgcgtcctaacgggcctctgggtcatagcccacgagtgcggccaccacgccttcagcgactac

SEQ ID NO: 8867 - DNA, 346 bp, Artificial
  Mutation in BnaC.FAD2.a introduced by TALE nuclease pair BnFAD2_T01
caggatccatgggtgcaggtggaagaatgcaagtgtctcctccctccaaaaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgactgcctctctactgggcccggcaagggttggtcctaaccggcgtctgggtcattgctcacgaggtcgggcaccgcggctttaaccactac

SEQ ID NO: 8868 - DNA, 355 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccaagggtgcgtcctaaccggcgtctgggtcatagcccacgagtgcggccaccacgccttcagcgactac

SEQ ID NO: 8869 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 8870 - DNA, 347 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacacaatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttcctctctactgggcctgccaagggtgcgtcctaaccggcctctgggtcatagcccacgagtgcggccaccacgccttcagcgactac

SEQ ID NO: 8871 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaatggcctctctactgggcctgccaagggtgcgtcctaacgggcctctgggtcatagcccacgagtgcggccaccacgccttcagcgactac

SEQ ID NO: 8872 - DNA, 433 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttaaagtcgcctaaggtcactatcagctagcaaatatttcttgtcaaattgatgagcaatgcttttttataatgccaactttcgcctggcctctctactgggcctgccaaggctgcgtcctaacgggcctctgggtcatagcccacgagtgcggccaccacgccttcagcgactac

SEQ ID NO: 8873 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttccactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 8874 - DNA, 380 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcacagtgtcccggcgcacgcgctctggaggcctgcctctctactgggcctgccaagggtgcgtcctaaccggcgtctgggtcatagcccacgagtgcggccaccacgccttcagcgactac

SEQ ID NO: 8875 - DNA, 344 bp, Artificial
  Mutation in BnaC.FAD2.a introduced by TALE nuclease pair BnFAD2_T01
cagtatccatgggtgcaggtgcaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctgctggacctgccaagggtgcgtcctaaccggcgtctgggtcatcgcccacgaatgcggccaccacgccttcagcgactac

SEQ ID NO: 8876 - DNA, 334 bp, Artificial
  Mutation in BnaC.FAD2.a introduced by TALE nuclease pair BnFAD2_T01
caggatccatgggtgcagggggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgctgccacggctgcgtcctaaccggcttctgggtcatagcccaccactgcggcccccccgccctcagcgactac

SEQ ID NO: 8877 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcccctctactgggcctgccaaggctgcgtcctaacgggcctctgggtcatcgcccacgaatgcggccaccacgccttcagcgactac

SEQ ID NO: 8878 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 8879 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgctgccaagggtgcgtcctcaccggcgtctgggtcatagcccacgagtgcggccaccacgccttcagcgactac

SEQ ID NO: 8880 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccacactgtttcaaacgctcgatccctcgctctttctcctacctcatctgggacatcatcatagcctcctgcttctactacgtcgccaccacttacttccctctcctccctcaccctctcccccacctggcctctctactgggcctgccaagggtgcgtcctaaccggcgtctgggtcatagcccacgagtgcggccaccacgccttcagcgactac

SEQ ID NO: 8881 - DNA, 329 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaacccaagaaagcaatcccaccgcactgtttcaaacgctcgatccctcgctctttctcctacctcatctgggacatcatcatagcctcctgcttctactacgtcgccaccacttacttccctctcctccctcaccctctctcctactgccaagggtgcgtcctaaccggcgtctgggtcatagcccacgagtgcggccaccacgccttcagcgactac

SEQ ID NO: 8882 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactatgtcgccaccacttacttccctctcctccctcaccgtcttgcgtactgccggcgcctggcctctctactgggcctgccaagggtgcgtcctaaccggcgtctgggtcatagcccacgagtgcggccaccacgccttcagcgactac

SEQ ID NO: 8883 - DNA, 323 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgcttcaaacgctcgatccctcgctctttctcctacctcatctgggacatcatcatagcctcctgcttctactacgtcgccaccacttacttccctcgagccacccactgggcctgccaagggtgcgtcctaaccggcgtctgggtcatagcccacgagtgcggccaccacgccttcagcgactac

SEQ ID NO: 8884 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacccctctactgggcctgccaaggctgcgtcctaaccggcgtctgggtcatagcccacgagtgcggccaccacgccttcagcgactac

SEQ ID NO: 8885 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccccactgtttcaaacgctcgctccctcgctctttctcctacctcatctgggataccctcatagcctcctgcttctactacgtcgcccccacttacttccctctcctccctcactctctcccctacgcctctctactgggcctgccaagggtgcgtcctaaccggcgtctgggtcatagcccacgagggcggccaccacgccttcagcgactac

SEQ ID NO: 8886 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctggaactgccaagggtgcgtcctaaccggcgtctgggtcatagcccaccagtgcggccaccacgccttcagcgactac

SEQ ID NO: 8887 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacctctctactgggcctgccaaggctgcgtcctaacgggcctctgggtcatagcccacgagtgcggccaccacgccttcagcgactac

SEQ ID NO: 8888 - DNA, 329 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgccaagggtgcgtcctaaccggcgtctgggtcatagcccacgagtgctgccaccacgccttcagcgactac

SEQ ID NO: 8889 - DNA, 321 bp, Artificial
  Mutation in BnaC.FAD2.a introduced by TALE nuclease pair BnFAD2_T01
caggatccatgggtgcaggtggcagaatgcaagtgtctactccctccaagaagtctgaaaccgacaccatcaagcgcgtaccctgcgagacaccgcccttcactgtcggagacctcaagaaagcaatcccacctcactgcttcaaacgctcaatccctcgctctttctcctacctcatctgggacatcatcatagcctcctgcttctactacgtcgccaccacttacttccctctcctccctcaccctctctcaagggtgcgtcctaaccggcgtctgggtcatagcccacgagtgcggccaccacgccttcagcgactac

SEQ ID NO: 8890 - DNA, 349 bp, Artificial
  Mutation in BnaC.FAD2.a introduced by TALE nuclease pair BnFAD2_T01
caggatccatgggtgaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcttctccctcaccctctctcctacttctggcctctctactgggcctgccaagggtgcgtcctaaccggcgtctgggtcatagcccacgagtgcggccaccacgccttcagcgactac

SEQ ID NO: 8891 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccggcttctctactgggcctgccaagggtgcgtcctaaccggcgtctgggtcatagcccacgagtgcggccaccacgccttcagcgactac

SEQ ID NO: 8892 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcaccaccacttacttccctctcctccctcaccctctctcctaccctcctctctactgggcctgccaagggtgcgtcctaaccggcgtctgggtcatagcccacgagtgcggccaccacgccttcagcgactac

SEQ ID NO: 8893 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcatacctcatctgggacatcatcatagcctcctgcttctactacgtcgccaccacttacttccctctcctccctcaccctctctcctacttcgtggtggcctctctactgggcctgccaagggtgcgtcctaaccggcgtctgggtcatagcccacgagtgcggccaccacgccttcagcgactac

SEQ ID NO: 8894 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagcgtgcgtcctaacgggcctctgggtcatagcccacgagtgcggccaccacgccttcagcgactac

SEQ ID NO: 8895 - DNA, 356 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 8896 - DNA, 404 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcggattagtccgactcaggagagcgttcaccgacaaacaacagataaaacgaaaggcccgcctggcctctctactgggcctgccaagggtgcgtcctaaccggcgtctgggtcatagcccacgagtgcggccaccacgccttcagcgactac

SEQ ID NO: 8897 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaagggtgcgtcctaaccggcgtctgggtcatagcccacgagtgcggccaccacgccttcagcgactac

SEQ ID NO: 8898 - DNA, 355 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 8899 - DNA, 329 bp, Artificial
  Mutation in BnaC.FAD2.a introduced by TALE nuclease pair BnFAD2_T01
caggatccatgggtgcaggtggaagaatgcaagtgtctcctccctacaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctccaccctcaccctctctcctactgccaagggtgcgtcctaaccggcgtctgggtcatagcccacgagtgcggcctccacgccttcagcgactac

SEQ ID NO: 8900 - DNA, 323 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccatccttcactctcggagacctcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagggtgcgtcctaacgggcctctgggtcatagcccacgagtgcggccaccacgccttcagcgactac

SEQ ID NO: 8901 - DNA, 350 bp, Artificial
  Mutation in BnaC.FAD2.a introduced by TALE nuclease pair BnFAD2_T01
caggatccatgggtgcaggtggcagaatgcaagtctctcctccctccagctcccccgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctacttggcctgccaagggtgcgtcctaaccggcgtctgggtcatagcccacgagtgcggccaccacgcctgcagcgactac

SEQ ID NO: 8902 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaacgggcctctgggtcatagcccacgagtgcggccaccacgccttcatcgactac

SEQ ID NO: 8903 - DNA, 341 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctctactgggcctgccaagggtgcgtcctaaccggcgtctgggtcatagcccacgagtgcggccaccacgccttcagcgactac

SEQ ID NO: 8904 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctccgactggcctctctactgggcctgccaagggtgcgtcctaaccggcgtctgggtcatagcccacgattgcggccaccacgccttcagcgactac

SEQ ID NO: 8905 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctgcttctctactgggcctgccaagggtgcggcctaaccggcgtctgggtcatagcccacgagtgcggccaccacgccatcagcgactac

SEQ ID NO: 8906 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacatcgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 8907 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgctggcctctctactgggcctgccaagggtgcgtcctaaccggcgtctgggtcatagcccacgagtgcggccaccacgccttcagcgactac

SEQ ID NO: 8908 - DNA, 323 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagggtgcgtcctaaccggcgtctgggtcatagcccacgagtgcggccaccacgccttcagcgactac

SEQ ID NO: 8909 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctacttcgcgcgcctggcctctctactgggcctgccaagggtgcgtcctaaccggcgtctgggtcatagcccacgagtgcggccaccacgccttcagcgactac

SEQ ID NO: 8910 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaatggtgcgtcctaaccggcgtctgggtcatagcccacgagtgcggccaccacgccttcagcgactac

SEQ ID NO: 8911 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgcttcaaacgctccatccctcgctctttctcctacctcatctgggacatcatcatagcctcctgcttctactacgtcgccaccacttacttccctctcctccctcaccctctctcctgggcctgccaagggtgcgtcctaaccggcgtctgggtcatagcccacgagtgcggccaccacgccttcagcgactac

SEQ ID NO: 8912 - DNA, 356 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaacgggcctctgggtcatagcccacgagtgcggccaccacgccttcagcgactac

SEQ ID NO: 8913 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 8914 - DNA, 318 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttggcaggcctctctactgggcctgccaagggtgcgtcctaaccggcgtctgggtcatagcccacgagtgcggccaccacgccttcagcgactac

SEQ ID NO: 8915 - DNA, 348 bp, Artificial
  Mutation in BnaC.FAD2.a introduced by TALE nuclease pair BnFAD2_T01
caggatccatgggtgcagggggaagaatgcaagtgtctactccctccaagaagtctgaaaacgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggccggccaagggtgcgtcctaacctgcgtcttggtcatagcccacgagtgcggccaccacgccatcagcgactac

SEQ ID NO: 8916 - DNA, 344 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaagggtgcgtcctaaccggcgtctgggtcatagcccacgagtgcggccaccacgccttcagcgactac

SEQ ID NO: 8917 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaaggctgcgtcctaacgggcctctgggtcatagcccacgagtgcggccaccacgccttcagcgactac

SEQ ID NO: 8918 - DNA, 355 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccaagggtgcgtcctaaccggcgtctgggtcatagcccacgagtgcggccaccacgccttcagcgactac

SEQ ID NO: 8919 - DNA, 348 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcgtccaccacgccttcagcgactac

SEQ ID NO: 8920 - DNA, 346 bp, Artificial
  Mutation in BnaC.FAD2.a introduced by TALE nuclease pair BnFAD2_T01
caggatccatggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 8921 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctccctctaccacctctccacagcctacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 8922 - DNA, 433 bp, Artificial
  Mutation in BnaC.FAD2.a introduced by TALE nuclease pair BnFAD2_T01
caggatccatgggtgcaggtggaagaatgcaagtgtctcatcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctactccctcaccctctctcctacttaaagtcgcctaaggtcactatcagctagcaaatatttcttgtcaaattgatgagcaatgcttttttataatgccaactttcgcctggcctctctactgggcctgccaagggtgcgtcctaaccggcgtctgggtcatagcccacgagtgctgccagaacgccttcagcgactac

SEQ ID NO: 8923 - DNA, 348 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctggcctctctactgggccggccaagggtgcgtcctaaccggcgtcggggtcatagcccacgagtgcggccaccacgccttcagcgactac

SEQ ID NO: 8924 - DNA, 349 bp, Artificial
  Mutation in BnaC.FAD2.a introduced by TALE nuclease pair BnFAD2_T01
caggatccatgggtgcaggtggaagaatgcaagtgtctccttcctccaagaagtctgaaaccgacaccatcaagcgcgtaccctgcgagacaccgcccttcactgtcggagaactcaagaaagcaatcccaccgcactgtttcaaacgctcgatccctcgctccttctcctcttcgacatcatcatctcctcctcggctcctccctctaccacctctccacagcctacttccctctcctccctcaccctctctcctacttggcctctctactgggcctgccaagggtgcgtcctaaccggcgtctgggtcatagcccacgagtgcggccaccacgccttcagcgactac

SEQ ID NO: 8925 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgccgcctggcctctctactgggcctgtcaagggtgcgtcctaaccggcgtctgggtcatagcccacgagtgcggccaccacgccttcagcgactac

SEQ ID NO: 8926 - DNA, 354 bp, Artificial
  Mutation in BnaC.FAD2.a introduced by TALE nuclease pair BnFAD2_T01
caggatccatgggtgcaggtggaagaatgcaagtctctcctccctccaaaaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctctccctctctcctacttcgccctggcctctctactgggcctgccaagggtgcgtcctaaccggcgtctgggtcatagcccacgagtgcggccaccacgccttcagcgactac

SEQ ID NO: 8927 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggcctgccaagggtgcgtcctaaccggcggctgggtcatagcccacgagtgcggccaccacgccttcagcgactac

SEQ ID NO: 8928 - DNA, 345 bp, Artificial
  Mutation in BnaC.FAD2.a introduced by TALE nuclease pair BnFAD2_T01
caggatccatgggtgcaggtggaagaatgcaagtctctcctcactccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaaggctgcgtcctaacgggcctctgggtcatcgcccacgaatgcggccaccacgcctgcagcgactac

SEQ ID NO: 8929 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtcttaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 8930 - DNA, 332 bp, Artificial
  Mutation in BnaC.FAD2.a introduced by TALE nuclease pair BnFAD2_T01
caggatccatgggtgcaggtgtaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 8931 - DNA, 269 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaatcgcgtaccctgcgagacaccgcccttcactgtcggagacctcaagaaagcaatcccaccgcactgtttcaaacgctccatccctcgctctttctcctacctcatctgggacatcatcatagcctcctgcttctaccacctaaccggcgtctgggtcatagcccacgagtgcggccaccacgccttcagcgactac

SEQ ID NO: 8932 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccccccgcctggcctctctactgggcctgccaagggtgcgtcctaaccggcgtctgggtcatagcccacgagtgcggccaccacgccttcagcgactac

SEQ ID NO: 8933 - DNA, 438 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacgtcgccagctgggccttgtagttgcccttgaagtggccggacacgaacaggaacttgaactcggtcacgctggaggggtacaccttccacctggcctctctactgggcctgccaagggtgcgtcctaaccggcgtcttggtcatcgcccacgaatgcggccaccacgccttcagcgactac

SEQ ID NO: 8934 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaatggcccctctactgggcctgccaaggctgcgtcctaacgggcctctgggtcatagcccacgagtgcggccaccacgccttcagcgactac

SEQ ID NO: 8935 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctggacatcatcatagcctcctgcttctactacgtcgccaccacttacttccctctcctccctcaccctctctcctggcctctctactgggcctgccaagggtgcgtcctaaccggcgtctgggtcatagcccacgagtgcggccaccacgccttcagcgactac

SEQ ID NO: 8936 - DNA, 345 bp, Artificial
  Mutation in BnaC.FAD2.a introduced by TALE nuclease pair BnFAD2_T01
caggatccatgggtgcaggtggaagaatgcaagtgtatactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaaccggcgtctgggtcatagcccacgagtgcgtccaccacgccttcagcgactac

SEQ ID NO: 8937 - DNA, 347 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattggcctctctactgggcctgccaagggtgcgtcctaaccggcgtcggggtcatagcccacgagtgcggccaccacgccttcagcgactac

SEQ ID NO: 8938 - DNA, 352 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccaagggtgcgtcctaaccggcgtctgggtcatagcccacgagtgcggccaccacgccttcagcgactac

SEQ ID NO: 8939 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccgcctggcctctctactgggcctgccaagggtgcgtcctaaccggcgtctgggtcatagcccccgattgcggccaccacgccttcagcgactac

SEQ ID NO: 8940 - DNA, 349 bp, Artificial
  Mutation in BnaC.FAD2.a introduced by TALE nuclease pair BnFAD2_T01
caggatccatgggtgcaggtggaagaatgcaagtctctccttcctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 8941 - DNA, 413 bp, Artificial
  Mutation in BnaC.FAD2.a introduced by TALE nuclease pair BnFAD2_T01
caggatccatgggtgcaggtggaagaatgcaagtgtatactcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacccggctgatttgtcctacccaggagagcgttcaccgacaaacaacagatacaacgaaaggcccagccggcctctctactgggcctgccaagggtgcgtcctaaccggcgtctgggtgatagcccacgagtgcggccagcacgcctgcagcgactac

SEQ ID NO: 8942 - DNA, 351 bp, Artificial
  Mutation in BnaC.FAD2.a introduced by TALE nuclease pair BnFAD2_T01
caggatccatgggtgcaggtggaagaatgcaagtgcctcctccctccaagaagtctgaaaccgacaccatcaagcgcgtaccctgcgagacaccgcccttcactgtcggataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaaggctgcgtcctaacgggcctctgggtcatagcccacgagtgcggcgaccacgccttcagcgactac

SEQ ID NO: 8943 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctccgccctcaccctctctcctacggcctctctactgggcctgccaagggtgcgtcctaaccggcgtctgggtcatagcccacgagtgcggccaccacgccttcagcgactac

SEQ ID NO: 8944 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactggtcttgccaagggtgcgtcctaaccggcgtctgggtcatagcccacgagtgcggccaccacgccttcagcgactac

SEQ ID NO: 8945 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtcttggtcatagcccacgagtgcggccaccacgccttcagcgactac

SEQ ID NO: 8946 - DNA, 355 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccaagggtgcgtcctaaccggcgtctgggtcatagcccacgagtgcggccaccacgccttcagcgactac

SEQ ID NO: 8947 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctggcacatcatcatagcctcctgcttctactacgtcgccaccacttacttccctctcctcccccaccctctctactgggcctgccaagggtgcgtcctaaccggcgtctgggtcatagcccacgagtgcggccaccacgccttcagcgactac

SEQ ID NO: 8948 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccaagggtgcgtcctaaccggcgtctgggtcatagcccacgagtgcgaccaccacgccttcagcgactac

SEQ ID NO: 8949 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgagacatcatcatagcctcctgcttctactacgtcgccaccacttacttccctctcctccctcaccctctctcctcccctggcctctctactgggcctgccaagggtgcgtcctaaccggcgtctgggtcatagcccacgagtgcggccaccacgccttcagcgactac

SEQ ID NO: 8950 - DNA, 351 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccgccctggcctctctactgggcctgccaagggtgcgtcctaaccggcgtctgggtcatagcccacgagtgcggccaccacgccttcagcgatac

SEQ ID NO: 8951 - DNA, 345 bp, Artificial
  Mutation in BnaC.FAD2.a introduced by TALE nuclease pair BnFAD2_T01
caggatccatgggtgccggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaacgggcctctgggtcatcgcccacgaatgcggccaccacgccttcagcgactac

SEQ ID NO: 8952 - DNA, 339 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccaagggtgcgtcctaaccggcgtctgggtcatagcccacgagtgcggccaccacgccttcagcgactac

SEQ ID NO: 8953 - DNA, 349 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagggcggccgccacgccttcagcgactac

SEQ ID NO: 8954 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 8955 - DNA, 355 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcgcctggcctctctactgggcctgccaagggtgcgtcctaaccggcgtctgggtcatagcccacgagtgcggccaccacgccttcagcgactac

SEQ ID NO: 8956 - DNA, 345 bp, Artificial
  Mutation in BnaC.FAD2.a introduced by TALE nuclease pair BnFAD2_T01
caggatccatgggtgcaggtggcagaatgcaagtgtctactcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatggcccacgagtgcggccaccacgcctgcagtgactac

SEQ ID NO: 8957 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctctcctacttctctactgggcctgccaagggtgcgtcctaaccggcgtctgggtcatagcccacgagtgcggccaccacgccttcagcgactac

SEQ ID NO: 8958 - DNA, 335 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttagcctgccaagggtgcgtcctaaccggcgtctgggtcatagcccacgagtgcggccaccacgccttcagcgactac

SEQ ID NO: 8959 - DNA, 324 bp, Artificial
  Mutation in BnaC.FAD2.a introduced by TALE nuclease pair BnFAD2_T01
caggatccatgggtgcaggtggaagaattcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcttgccaagggtgcgtcctaaccggcgtctgggtcatagcccacgagtgcggccaccacgccttcagcgactac

SEQ ID NO: 8960 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgcccctggcctctctactgggcctgccaagggtgcgtcctaaccggcgtctgggtcatagcccacgagtgcggccaccacgccttcagcgactac

SEQ ID NO: 8961 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggtgcctggcctctctactgggcctgccaagggtgcgtcctaaccggcgtctgggtcatagcccacgagtgcggccaccacgccttcagcgactac

SEQ ID NO: 8962 - DNA, 347 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcgagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 8963 - DNA, 383 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcagcggctgttgccggtgctgtgccaggcccacggcttctctctactgggcctgccaagggtgcgtcctaaccggcgtctgggtcatagcccacgagtgcggccaccacgccttcagcgactac

SEQ ID NO: 8964 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgtctctctgctgggcctgccaagggtgcgtcctaaccggcgtctgggtcatagcccacgagtgcggccaccacgccttcagcgactac

SEQ ID NO: 8965 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggcgcctggcctctctactgggcctgccaagggtgcgtcctaaccggcgtctgggtcatagcccacgagtgcggccaccacgccttcagcgactac

SEQ ID NO: 8966 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccttcggctctctactgggcctgccaagggtgcgtcctaaccggcgtctgggtcatagcccacgagtgcggccaccacgccttcagcgactac

SEQ ID NO: 8967 - DNA, 389 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccacccacgtataaaccgtcgatgccctgctgaatattgaactgaaccaggcgactggcctctctactgggcctgccaagggtgcgtcctaaccggcgtctgggtcatagcccacgattgcggccaccacgccatcagcgactac

SEQ ID NO: 8968 - DNA, 347 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctggcctctctactgggcctgccaagggtgcgtcctaaccggcgtctgggtcatagcccacgagtgcggccaccacgccttcagcgactac

SEQ ID NO: 8969 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 8970 - DNA, 409 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcaaataatgattttattttgactgatagtgacctgttcgttgcaacaaattgatgagctctctactgggcctgccaagggtgcgtcctagccggcgtctgggtcatagcccacgagtgcggccaccacgccttcagcgactac

SEQ ID NO: 8971 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccggtgctgccaagggtgcgtcctaaccggcgtctgggtcatagcccacgagtgcggccaccacgccttcagcgactac

SEQ ID NO: 8972 - DNA, 335 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgtcctaaccggcgtctgggtcatagcccacgagtgcgtccaccacgccttcagcgactac

SEQ ID NO: 8973 - DNA, 356 bp, Artificial
  Mutation in BnaC.FAD2.a introduced by TALE nuclease pair BnFAD2_T01
caggatccattggtgcaggtggcagaatgcaagtgtctcctccctccaagaagtctgaaaccgacaccatcaagcgcttaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 8974 - DNA, 351 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcagtcccacctcactgcttcaaacgctccatccctcgctctttctcctacctcatctgggacatcatcatagcctcctgcttctactacgtcgccaccacttacttccctctcctccctcaccctctctcctacttctgggcctctctactgggcctgccaagggtgcgtcctaaccggcgtctgggtcatagcccacgagtgcggccaccacgccttcagcgactac

SEQ ID NO: 8975 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccatcagcgactac

SEQ ID NO: 8976 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttggcctctctactgggcctgccaagggtgcgtcctaacgggcctctgggtcatagcccacgagtgcggccaccacgccttcagcgactac

SEQ ID NO: 8977 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttggcctctctactgggcctgccaagggtgcgtcctaacgggcctctgggtcatagcccacgagtgcggccaccacgccttcagcgactac

SEQ ID NO: 8978 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatcccccgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 8979 - DNA, 354 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccgccctggcctctctactgggcctgccaagggtgcgtcctaacgggcctctgggtcatagcccacgagtgcggccaccacgccatcagcgactac

SEQ ID NO: 8980 - DNA, 355 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 8981 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccggcctctctactgggcctgccaagggtgcgtcctaaccggcgtctgggtcatagcccacgagtgcggccaccacgccttcagcgactac

SEQ ID NO: 8982 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctcattctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 8983 - DNA, 383 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccataaagcgcgtaccctgcgagacaccgcccttcactatcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcagcggctgttgccggtgctgtgccaggcccacggcttctctctactgggccggccaagggtgcgtcttaaccggcgtctgggtcatagcccacgagtgcggccaccacgccttcagcgactac

SEQ ID NO: 8984 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 8985 - DNA, 356 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgacgcctggcctctctactgggcctgccaagggtgcgtcctaaccggcgtctgggtcatagcccacgagtgcggccaccacgccttcagcgactac

SEQ ID NO: 8986 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctggggcatagcccacgagtgcggccaccgcgcctgcagcgactac

SEQ ID NO: 8987 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcgtccaccacgccttcagcgactac

SEQ ID NO: 8988 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttggcctctctactgggcctgccaagggtgcgtcctaaccggcgtctgggtcatagcccacgagtgcggccaccacgccttcagcgactac

SEQ ID NO: 8989 - DNA, 335 bp, Artificial
  Mutation in BnaC.FAD2.a introduced by TALE nuclease pair BnFAD2_T01
caggatccatgggtgcaggtggaagaatgcaagtctctcctccccccagctcccccgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgtcctaaccggcgtctgggtcatagcccacgagtgcggccaccacgccttcagcgactac

SEQ ID NO: 8990 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaaggctgcgtcctaaccggcgtctgggtcatagcccacgagtgcggccaccacgccttcagcgactac

SEQ ID NO: 8991 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctagcctctctactgggcctgccaagggtgcgtcctaaccggcgtctgggtcatagcccacgagtgcggccaccacgccttcagcgactac

SEQ ID NO: 8992 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 8993 - DNA, 347 bp, Artificial
  Mutation in BnaC.FAD2.a introduced by TALE nuclease pair BnFAD2_T01
caggatccatgggtgcaggtggcagaatgcaagtctctcctccctccagctcccccggaaccaacaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctactggcctctctactgggcctgccaagggtgcgtcctaacctgcgtctgggtcatagcccacgagtgcggccaccacgccttcagcgactac

SEQ ID NO: 8994 - DNA, 340 bp, Artificial
  Mutation in BnaC.FAD2.a introduced by TALE nuclease pair BnFAD2_T01
catgatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctactctactgggcctgccaagggtgcgtcctaaccggcgtctgggtcatagcccacgagtgcggccaccactccttcagcgactac

SEQ ID NO: 8995 - DNA, 323 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagggtgcgtcctaaccggcgtctgggtcatagcccacgagtgcggccaccacgccttcagcgactac

SEQ ID NO: 8996 - DNA, 318 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccaagggtgcgtcctaacgggcctctgggtcatagcccacgagcgcggccaccacgccttcagcgactac

SEQ ID NO: 8997 - DNA, 312 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaacgggcctctgggtcatagcccacgagtgcggccaccacgccttcagcgactac

SEQ ID NO: 8998 - DNA, 413 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacccggcggatttgtcctactcaggagagcgttcaccgacaaacaacagataaaacgaaaggcccagtcggcctctctactgggcctgccaagggtgcgtcctaaccggcgtctgggtcatagcccacgagtgcggccaccacgccttcagcgactac

SEQ ID NO: 8999 - DNA, 349 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgggcctctctactgggcctgccaagggtgcgtcctaaccggcgtctgggtcatagcccacgagtgcggccaccacgccttcagcgactac

SEQ ID NO: 9000 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctacctcaccctctctcctacttggcctctctactgggcctgccaagggtgcgtcctaaccggcgtctgggtcatagcccacgagtgcggccaccacgccttcagcgactac

SEQ ID NO: 9001 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctgcctctctactgggcctgccaagggtgcgtcctaaccggcgtctggtcatagcccacgagtgcggccaccacgccttcagcgactac

SEQ ID NO: 9002 - DNA, 300 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccaagggtgcgtcctaacgggcctctgggtcatagcccacgagtgcggccaccacgccttcagcgactac

SEQ ID NO: 9003 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcacgaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 9004 - DNA, 390 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaagcgcgtaccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctcccctacttgctggcggtggcaagcacctgctggggggtcaagccgtgggcggcctctctactgggcctgccaagggtgcgtcctaaccggcgtctgggtcatagcccacgagtgcggccaccacgccttcagcgactac

SEQ ID NO: 9005 - DNA, 332 bp, Artificial
  Mutation in BnaC.FAD2.a introduced by TALE nuclease pair BnFAD2_T01
caggatccatgggtgcaggtcgaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcgaccaccacgccttcagcgactac

SEQ ID NO: 9006 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccaacctctctactgggcctgccaagggtgcgtcctaaccggcgtctgggtcatagcccacgagtgcggccaccacgccttcagcgactac

SEQ ID NO: 9007 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccaagggtgcgtcctaacgggcctctgggtcatagcccacgagtgcggccaccacgccttcagcgactac

SEQ ID NO: 9008 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 9009 - DNA, 346 bp, Artificial
  Mutation in BnaC.FAD2.a introduced by TALE nuclease pair BnFAD2_T01
caggatccatgggtgcaggtggaagaatgcaaatgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgagtgcggccaccacgccttcagcgactac

SEQ ID NO: 9010 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgccaagggtgcgtcctaaccggcgtctgggtcatagcccacgagtgcggccaccacgccttcagcgactac

SEQ ID NO: 9011 - DNA, 350 bp, Artificial
  Mutation in BnaC.FAD2.a introduced by TALE nuclease pair BnFAD2_T01
aaggatccatgggtgcaggtggaagaatgcaagtgtctcctccctccaagaagtctgaaaccgacaccatcaagctcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccatcagcgactac

SEQ ID NO: 9012 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttagcctctctactgggcctgccaagggtgcgtcctaaccggcgtctgggtcatagcccacgagtgcggccaccacgccttcagcgactac

SEQ ID NO: 9013 - DNA, 390 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttgctggcggtggcaagcacctgctggggggtcaagccgtgggcggcctctctactgggcctgccaagggtgcgtcctaaccggcgtctgggtcatagcccacgagtgcggccaccacgccttcagcgactac

SEQ ID NO: 9014 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcacggtttcaaacgctcgatccctcgctctttctcctacctcatctgggacatcatcatagcctcctgcttctactacgtcgccaccacttacttccctctcctccctcaccctctctcctacttgcctccctactgggcctgccaagggtgcgtcctaaccggcgtctgggtcatagcccacgagtgcggccaccacgccttcagcgactac

SEQ ID NO: 9015 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaaccggcgtctgggtcatagcccacgagtgcggccaccacgccttcagcgactac

SEQ ID NO: 9016 - DNA, 355 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 9017 - DNA, 349 bp, Artificial
  Mutation in BnaC.FAD2.a introduced by TALE nuclease pair BnFAD2_T01
caggatccatgggtgcaggtggaagaatgcaagtgtctaatccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccatgggtgcgtcctaaccggcgtctgggtcatagcccacgagtgcggccaccacgccttcagcgactac

SEQ ID NO: 9018 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctggcacatcatcatagcctcctgcttctactacgtcgccaccacttacttccctctcctccctcaccctctctccgactggcctctctactgggcctgccaagggtgcgtcctaaccggcgtctgggtcatagcccacgagtgcggccaccacgccttcagcgactac

SEQ ID NO: 9019 - DNA, 351 bp, Artificial
  Mutation in BnaC.FAD2.a introduced by TALE nuclease pair BnFAD2_T01
caggatccatgggtgcaggtggcagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgggcctctctactgggcctgccaagggtgcgtcctaaccggcgtctgggtcatagcccacgagtgcggccaccacgccttcagcgactac

SEQ ID NO: 9020 - DNA, 357 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccgcccgcctggcctctctactgggcctgccaagggtgcgtcctaaccggcgtctgggtcatagcccacgagtgcggccaccacgccttcagcgactac

SEQ ID NO: 9021 - DNA, 405 bp, Artificial
  Mutation in BnaC.FAD2.a introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcccctccctcaccctctctcctactccgcaatgcactgacgggtgccccgctcaacttgaccccccagcaggtggtggccagcggcctctctactgggcctgcctagggtgcgtcctaaccggcgtctgtgtcatatcccacgagtgctgccaccacgcctgcagcgactac

SEQ ID NO: 9022 - DNA, 322 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcagcggctgttgccggtgctgtgccaggcccacgagtgcggccaccacgccttcagcgactac

SEQ ID NO: 9023 - DNA, 350 bp, Artificial
  Mutation in BnaC.FAD2.a introduced by TALE nuclease pair BnFAD2_T01
caggatccattggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 9024 - DNA, 401 bp, Artificial
  Mutation in BnaC.FAD2.a introduced by TALE nuclease pair BnFAD2_T01
caggatccatgggtgcaggtggcagaatgcaagtgactcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccataaactgccaggcatcaaactaagcagaaggccatccgtccataggctggcctctctactgtgccggcgaagggggcggccgagccggcgtctgtgtcatagcccacgagggtgtcctccacgccaacagcgactac

SEQ ID NO: 9025 - DNA, 338 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactactgggcctgccaagggtgcgtcctaaccggcgtctgggtcatagcccacgagtgcggccaccacgccttcagcgactac

SEQ ID NO: 9026 - DNA, 312 bp, Artificial
  Mutation in BnaC.FAD2.a introduced by TALE nuclease pair BnFAD2_T01
caggatccatgggtgcaggtagcagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 9027 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctacggggcctgccaagggtgcgtcctaaccggcgtctgggtcatagcccacgagtgcggccaccacgccttcagcgactac

SEQ ID NO: 9028 - DNA, 350 bp, Artificial
  Mutation in BnaC.FAD2.a introduced by TALE nuclease pair BnFAD2_T01
caggatccatgggtgcaggtggaagaatgcaagtgtctcctccctcccaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtctggcctctctactgggcctgccaagggtgcgtcctaaccggcgtctgggtcatagcccacgagtgcggccaccacgccttcagcgactcc

SEQ ID NO: 9029 - DNA, 351 bp, Artificial
  Mutation in BnaC.FAD2.a introduced by TALE nuclease pair BnFAD2_T01
caggatccatgggtgcaggtggcagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactacgcggcctctctactgggcctgccaagggtgcgtcctaaccggcgtctgggtcatagcccacgagtgcggccaccacgccttcagcgactac

SEQ ID NO: 9030 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggccctctactgggcctgccaaggctgctgcctaacgggcctctgggtcatcgcccacgaatgctgccaccacgcctgcagcgactac

SEQ ID NO: 9031 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccaaggctgcgtcctaacgggcctctgggtcatagcccacgagtgcggccaccacgccttcagcgactac

SEQ ID NO: 9032 - DNA, 343 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctgcctctctactgggcctgccaaggctgcgtcctaacgggcctctgggtcatcgcccacgaatgcggccaccacgccctcagcgactac

SEQ ID NO: 9033 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaaggctgcgtcctaacgggcctctgggtcatagcccacgagtgcggccaccacgccttcagcgactac

SEQ ID NO: 9034 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggtgcctggcctctctactgggcctaccaagggtgcgtcctaaccggcgtctgggtcatcgcccacgagtgcggccaccacgccttcagcgactac

SEQ ID NO: 9035 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcaccaccacttacttccatctcctccctcaccctctctcctgcttctggcctctctactgggcctgccaaggctgcgtcctaacgggcctctgggtcatcgcccacgaatgcggccaccacgccttcagcgactac

SEQ ID NO: 9036 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcccctggcctctctactgggcctgccaagggtgcgtcctaaccggcgtctgggtcatagcccacgagtgcggccaccacgccttcagcgactac

SEQ ID NO: 9037 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccaagggtgcgtcctaaccggcgtctgggtcatagcccacgagtgcggccaccacgccttcagcgactac

SEQ ID NO: 9038 - DNA, 374 bp, Artificial
  Mutation in BnaC.FAD2.a introduced by TALE nuclease pair BnFAD2_T01
caggatccatgggtgcaggtggaagaatgcaagtgtctcatccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccaggattatcttggacaagaagaagatcgctctctactgggcctgccaagggtgcgtcctaaccggcgtctgggtcatagcccacgagtgcgtccaccacgccttcagcgactac

SEQ ID NO: 9039 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggctgcgtcctaacgggcctctgggtcatagcccacgagtgcggccaccacgccttcagcgactac

SEQ ID NO: 9040 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgagtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctaccgggcctgccaagggtgtgtcctaaccggcgtctgggtcatagccctcgagtgcggccaccacgccttcagcgactac

SEQ ID NO: 9041 - DNA, 345 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaagggtgcgtcctaaccggcgtctgggtcatagcccacgagtgcggccaccacgccagcagcgactac

SEQ ID NO: 9042 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcgccagctgggcctgccaagggtgcgtcctaaccggcgtctgggtcatagcccacgagtgcggccaccacgccttcagcgactac

SEQ ID NO: 9043 - DNA, 340 bp, Artificial
  Mutation in BnaC.FAD2.a introduced by TALE nuclease pair BnFAD2_T01
caggatccatgggtgcaggtcgaagaatgcaagtacctcctccctccaagaagtctgaaaccgacaccatcaagcgcgtaccctgcgagacaccgcccttcactgtcggagaactcaagaaagcaatctcaccgcactgtttcaaacgctcgatccctcgctctttctcctacctcatctgggacatcatcatagcctcctgcttctactacgtcgccaccacttacttccctctcctccctcaccctctctcctactctactgggcctgccaagggtgcgtcctaaccggcgtctgggtcatagcccacgagtgcggccaccacgccttcagcgactac

SEQ ID NO: 9044 - DNA, 334 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacatcgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgctgccaagggtgcgtcctaaccggcgtctgggtcatagcccacgagtgcggccaccacgccttcagcgactac

SEQ ID NO: 9045 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgtggccaccacgccttcagcgactac

SEQ ID NO: 9046 - DNA, 338 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaagggtgcgtcctaaccggcgtctgggtcatatcccacgagtgcggccaccacgccatcagcgactac

SEQ ID NO: 9047 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccatctcctccctcaccctctctcctacctctctactgggcctgccaagggtgcgtcctaaccggcgtctgggtcatagcccacgagtgcggccaccacgccttcagcgactac

SEQ ID NO: 9048 - DNA, 342 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgcctctctactgggcctgccaagggtgcgtcctaacctgcgtctgggtcatagcccacgagtgcggccaccacgccttcagcgactac

SEQ ID NO: 9049 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacgtcatcatagcctcctgcttctactacgtcgccaccacttacttccctctcctccctcaccctctctcctacttctgggcctctctactgggcctgccaagggtgcgtcctaaccggcgtctgggtcatagcccacgagtgcggccaccacgccttcagcgattac

SEQ ID NO: 9050 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaaccggcgtctgggtcatagcccacgagtgcggccaccacgccttcagcgactac

SEQ ID NO: 9051 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcgccctctcgccgtcggcactctactgggcctgacaagggtgcggcctaaccggcggctgggtcatagcccacgagtgcggccaccacgccttcagcgactac

SEQ ID NO: 9052 - DNA, 342 bp, Artificial
  Mutation in BnaC.FAD2.a introduced by TALE nuclease pair BnFAD2_T01
caggatccatgggtgcaggtggcagaatgcaagtgtctcctccctacaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgcctctctactgggcctgccaagggtgcgtcctaaccggcgtctgggtcatagcccacgagtgcggccaccacgccttcagcgactac

SEQ ID NO: 9053 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccatcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 9054 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaacctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaaggctgcgtcctaaccggcgtctgggtcatagcccacgagtgcggccaccacgccttcagcgactac

SEQ ID NO: 9055 - DNA, 347 bp, Artificial
  Mutation in BnaC.FAD2.a introduced by TALE nuclease pair BnFAD2_T01
caggatccatgggtgcggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 9056 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 9057 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 9058 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggccggccaagggtgcgtcctaaccggcgtctgggtcatagcccacgagtgcggccaccacgccttcagcgactac

SEQ ID NO: 9059 - DNA, 355 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 9060 - DNA, 354 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggtggcctctctactgggcctgccaagggtgcgtcctaaccggcgtctgggtcatagcccacgagtgcggccaccacgccttcagcgactac

SEQ ID NO: 9061 - DNA, 340 bp, Artificial
  Mutation in BnaC.FAD2.a introduced by TALE nuclease pair BnFAD2_T01
caggatccatgggtgcagctggaagaatgcaagtgtctcatccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccaggggtgcgtcctaaccggcgtctgggtcatagcccacgatttcggccaccacgccttcagctactac

SEQ ID NO: 9062 - DNA, 334 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatccaaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccacgaatgcgtccaccacgccttcagcgactac

SEQ ID NO: 9063 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgtggcctctctactgggcctgccaagggtgcgtcctaaccggcgtctgggtcatagcccacgagtgcggccaccacgccttcagcgactac

SEQ ID NO: 9064 - DNA, 338 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctggtacatcatcatagcctcctgcttctactacgtcgccaccacttacttccctctcctccctcaccctctctctctctactgggcctgccaagggtgcgtcctaaccggcgtctgggtcatagcccacgagtgcggccaccacgccttcagcgactac

SEQ ID NO: 9065 - DNA, 356 bp, Artificial
  Mutation in BnaC.FAD2.a introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 9066 - DNA, 351 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccaagggtgcgtcctaaccggcgtctgggtcatagcccacgagtgcggccaccacgccttcagcgactac

SEQ ID NO: 9067 - DNA, 380 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacagtggtccggcgcacgcgctcgggaggcctgcctctctactgggcctgccaagggtgcgtcctaaccggcgtctgggtcatagcccacgagtgcggccaccacgccttcagcgactac

SEQ ID NO: 9068 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcccacttggcctctctactgggcctgccaagggtgcgtcctaaccggcgtctgggtcatagcccacgagtgcggccaccacgccttcagcgactac

SEQ ID NO: 9069 - DNA, 356 bp, Artificial
  Mutation in BnaC.FAD2.a introduced by TALE nuclease pair BnFAD2_T01
caggatccattggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 9070 - DNA, 344 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaagggtgcgtcctaaccggcgtctgggtcatagcccacgatggcggccaccacgccttcagcgactac

SEQ ID NO: 9071 - DNA, 414 bp, Artificial
  Mutation in BnaC.FAD2.a introduced by TALE nuclease pair BnFAD2_T01
caggatccatgggtgcaggtggcagaatgcaagtctctactccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccgccggcaaaatcgcgccgaaggatgtcgctgccgactgggcaatggagcgcctgccggcccacctggcctctctactgggcctgccaagggtgcgtcctaacgggcctctgggtcatagcccacgagtgcggccaccacgccttcagcgactac

SEQ ID NO: 9072 - DNA, 348 bp, Artificial
  Mutation in BnaC.FAD2.a introduced by TALE nuclease pair BnFAD2_T01
caggatccatgggtgcaggtgggagaatgcaagtttctcctcccttcaagaagtctgaaaccgacaccatcaagcgcgtacccagcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccaacttggcctctctactgggccggccaagggtgcgtcctaacgtgcctcttgttcatagcccacgagtgctgccgccactccttcatcgactac

SEQ ID NO: 9073 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttcacctacctcatctgggacatcatcatagcctcctgcttctactacgtcgccaccacttacttccctctcctccctcaccctctctcctactcctctctactgggcctgccaagggtgcgtcctaaccggcgtctgggtcatagcccacgagtgcggccaccacgccttcagcgactac

SEQ ID NO: 9074 - DNA, 340 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttactgggcctgccaagggtgcgtcctaaccggcgtctgggtcatagcccacgagtgcggccaccacgccttcagcgactac

SEQ ID NO: 9075 - DNA, 351 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaaccggcgtctgggtcatagcccacgagtgcggccaccacgccttcagcgactac

SEQ ID NO: 9076 - DNA, 344 bp, Artificial
  Mutation in BnaC.FAD2.a introduced by TALE nuclease pair BnFAD2_T01
caggatccatgggtgcaggtgggagaatgcaagtgtctactccctcccagaagtctgaaaccgacaccatcaagggcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcggcctaaccggtgtctggggtatagcccacgagtgcggccaccacgccgtcagcactac

SEQ ID NO: 9077 - DNA, 348 bp, Artificial
  Mutation in BnaC.FAD2.a introduced by TALE nuclease pair BnFAD2_T01
caggatccatgggtgcaggtggcagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 9078 - DNA, 312 bp, Artificial
  Mutation in BnaC.FAD2.a introduced by TALE nuclease pair BnFAD2_T01
caggatccatgggtgcaggtgccagaatgcaagtgtctcctccctccaacacgcctgaacccgacaccatcaagcgcgtaccctgcgagacaccacccttcactgtcggagaactcaagaaagcaatcccaccgcactgtttcaaacgctcgatccctcgctctttctcctacctcatctgcgacatcatcatagcctcctgcctctactacgtccccaccccgtacttccctctcctccctcaccctctgcgtcctaaccggccgctgggtcagagcccacgattgcggccaccacgccttcagcgactac

SEQ ID NO: 9079 - DNA, 341 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctggcccctctactgggcctgccaagggtgcgtcctaaccggcgtctgggtcatagcccacgagtgcggccaccacgcctgcagcgactac

SEQ ID NO: 9080 - DNA, 277 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctcgcctccctcaccctctctccgactccgcgccttcagcgactac

SEQ ID NO: 9081 - DNA, 346 bp, Artificial
  Mutation in BnaC.FAD2.a introduced by TALE nuclease pair BnFAD2_T01
caggatccatgggtgcaggtggcagaatgcaagtgtcccctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaaccggcgtctgggtcatagcccacgagtgcggccaccacgccttcagcgactac

SEQ ID NO: 9082 - DNA, 351 bp, Artificial
  Mutation in BnaC.FAD2.a introduced by TALE nuclease pair BnFAD2_T01
caggatccatgggtgcaggtggaagaatgcaagtgtctcctccctcccagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgaggcctctctactgggcctgccaagggtgcgtcctaaccggcgtctgggtcatagcccacgagtgcggccaccacgccttcagcgactac

SEQ ID NO: 9083 - DNA, 347 bp, Artificial
  Mutation in BnaC.FAD2.a introduced by TALE nuclease pair BnFAD2_T01
caggatccatgggtgcaggtgaaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 9084 - DNA, 395 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcaaactcttcctggctagcggtacgcgtattaattgcgtcctggcctctctactgggcctgccaagggtgcgtcctaaccggcgtctgggtcatagcccacgagtgcggccaccacgccttcagcgactac

SEQ ID NO: 9085 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctggcctctctactgggcctgccaagggtgcgtcctaaccggcgtctgggtcatagtccacgagtgcggccaccacgccttcagcgactac

SEQ ID NO: 9086 - DNA, 344 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctagcctctctactggacctgccaagggtgcgtcctaacgggcgtctgggtcatagcccacgagtgcggccaccacgccttcagcgactac

SEQ ID NO: 9087 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgccctgtttcaaacgctcgatccctcgctctttctcctacctcatctgggacatcatcatagcctcctgcttctactacgtcgccaccacttacttccctctcctcccccaccctctctcctacttggcctctctactgggcctgccaagggtgcgtcctaaccggcgtctgggtcatagcccacgagtgcggccaccacgccttcagcgactac

SEQ ID NO: 9088 - DNA, 405 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatatgggacatcatcatagcctcctgcttctactacgtcgccaccacttacttccctctcctccctcaccctctctcctacttcgcaatgcactgacgggtgccccgctcaacttgaccccccagcaggtggtggccatcggcctctctactgggcctgccaagggtgcgtcctaaccggcgtctgggtcatagcccacgagtgcggccaccacgccttcagcgactac

SEQ ID NO: 9089 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcaccaccacttacttccctctcctccctcaccctctctactgggcctgccaagggtgcgtcctaaccggcgtctgggtcatagcccacgagtgcggccaccacgccttcagcgactac

SEQ ID NO: 9090 - DNA, 347 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 9091 - DNA, 334 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggccggccaagggtgcgtcctaaccggcgtctgggtcatagcccacgagtgcggccgccacgccttcagcgactac

SEQ ID NO: 9092 - DNA, 350 bp, Artificial
  Mutation in BnaC.FAD2.a introduced by TALE nuclease pair BnFAD2_T01
caggatccatgggtgcaggtggaagaatgcaagtgtctcctccctcccagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggccggccaagggggcggccgagccggcgtctgggtcatagcccaggagggcggccaccacgccttcagcgactac

SEQ ID NO: 9093 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgcctgcagcgactac

SEQ ID NO: 9094 - DNA, 350 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 9095 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctaagtcgccctctctactgggcctgccaagggtgcggcctaaccggcgtctgggtcatagcccacgagtgcggccaccacgccatcagcgactac

SEQ ID NO: 9096 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctcctctctactgggccggccaagggtgcgtcctaaccggcgtctgtgtcatagcccacgagtgcggccaccacgccgtcagcgactac

SEQ ID NO: 9097 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctaatctgggacatcatcatagcctcctgcttctactacgtcgccaccacttacttccctctcctccctcaccctctctcctacttcgcctttggcctctctactgggcctgccaagggtgcgtcctaaccggcgtctgggtcatagcccacgagtgcggccaccacgccttcagcgactac

SEQ ID NO: 9098 - DNA, 342 bp, Artificial
  Mutation in BnaC.FAD2.a introduced by TALE nuclease pair BnFAD2_T01
caggatccatgggtgcaggtggcagaatgcaagtgtctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctcgcctggcctctctactgggcctgccaagggtgcgtcctaaccggcgtctgggtcatagcccacgagtgcggccaccacgccttcagcgactac

SEQ ID NO: 9099 - DNA, 346 bp, Artificial
  Mutation in BnaC.FAD2.a introduced by TALE nuclease pair BnFAD2_T01
caggatccacgggtgcaggtggaagaatgcaagtgtctcctccctccaagaagtctgaaaccgacaccatcaagcgcgtaccctgcgagacaccgcccttcactgtcggagaactcaagaaagcaatcccaccgaactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 9100 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaacgggcctctgggtcatcgcccacgaatgcggccaccacgccttcagcgactac

SEQ ID NO: 9101 - DNA, 350 bp, Artificial
  Mutation in BnaC.FAD2.a introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccaccagtgcggccaccacgccttcagccactac

SEQ ID NO: 9102 - DNA, 356 bp, Artificial
  Mutation in BnaC.FAD2.a introduced by TALE nuclease pair BnFAD2_T01
caggatccatgggtgcaggtggcagaatgcaagtatctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 9103 - DNA, 329 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgccaagggtgcgtcctaaccggcgtctgggtcatagcccacgagtgcgggcaccacgccttcagcgactac

SEQ ID NO: 9104 - DNA, 342 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaagggtgcgtcctaaccggcgtctgggtcatagcccacgagtgcggccaccacgccttcagcgactac

SEQ ID NO: 9105 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaacgggcctctgggtcatagcccacgagtgcggccaccacgcctgcagcgactac

SEQ ID NO: 9106 - DNA, 337 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctctactgggcctgccaagggtgcgtcctaaccggcgtctgggtcatagcccacgagtgcggccaccacgccttcagcgactac

SEQ ID NO: 9107 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctggtacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 9108 - DNA, 358 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctcgcctggcctctctactgggcctgccaagggtgcgtcctaaccggcgtctgggtcatagcccacgagtgcggccaccacgccttcagcgactac

SEQ ID NO: 9109 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtccgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 9110 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 9111 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacgacggcctctctactgggcctgccaagggtgcggcctaaccggcgtctgggtcatagcccacgagtgcggccaccacgccttcagcgactac

SEQ ID NO: 9112 - DNA, 403 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctccccctcaccctctctcctacttcgcttgccgccatcgtggctggcgatggccaccacctgctccggggtcaagccgtgggcctctctactgggcctgccaagggtgcgtcctaaccggcgtctgggtcatagcccacgagtgcggccaccacgccttcagcgactac

SEQ ID NO: 9113 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgctggcctctctactgggcctgccaagggtgcgtcctaaccggcgtctgggtcatagcccaccagtgcggccaccacgccttcagcgactac

SEQ ID NO: 9114 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttcgcctctctacagggcctgccaagggtgcgtcctaaccggcgtctgggtcatagcccacgagtgcggccaccacgccttcagcgactac

SEQ ID NO: 9115 - DNA, 323 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaattccaccgcactgtttcaaacgctcgatccctcgctctttctcctacctcatctgggacatcatcatagcctcctgcttctactacgtcgccaccacttacttccctcgagccacccactgggcctgccaagggtgcgtcctaaccggcgtctgggtcatagcccacgagtgcggccaccacgccttcagcgactac

SEQ ID NO: 9116 - DNA, 349 bp, Artificial
  Mutation in BnaC.FAD2.a introduced by TALE nuclease pair BnFAD2_T01
cagtatccatgggtgcaggtgccagaatgcaagtttctcctccctccagctcccccggaaccaacacactcaaccgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcagagcccaccagggcggccaccacgcctgcatcgactac

SEQ ID NO: 9117 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtcctaaccggcgtctgggtcatagcccacgagtgcggccaccacgccttcagcgactac

SEQ ID NO: 9118 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacccctctactgggcctgccaaggctgcgtcctaacgggcctctgggtcatcgcccacgaatgcggccaccacgccttcagcgactac

SEQ ID NO: 9119 - DNA, 378 bp, Artificial
  Mutation in BnaC.FAD2.a introduced by TALE nuclease pair BnFAD2_T01
caggatccatgggtgcaggtgggagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctccagcgcctgcttgccgccatcgtggctggcgatggccaccacctgctccggggtcaagccgtgagggctgggtcatagcccacgagtgcggccaccacgccttcagcgactac

SEQ ID NO: 9120 - DNA, 343 bp, Artificial
  Mutation in BnaC.FAD2.a introduced by TALE nuclease pair BnFAD2_T01
caggatccatgggtgcagatggcagaatgcaagtgtctcctccctcaaagaagtctgaaaccgacacaatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaaggctgcgtcctaacgggcctctgggtcatagcccacgagtgcggccaccacgccttcagcgactac

SEQ ID NO: 9121 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccaagggtgcggcctaaccggcgtctgggtcatagcccacgagtgcggccaccacgccttcagcgactac

SEQ ID NO: 9122 - DNA, 345 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaagggtgcgtcctaacgggcctctgggtcatcgcccacgaatgcggccaccacgccttcagcgactac

SEQ ID NO: 9123 - DNA, 324 bp, Artificial
  Mutation in BnaC.FAD2.a introduced by TALE nuclease pair BnFAD2_T01
caggatccatgggtgcaggtggaagaatgcaagtctctcctccctccagctcccccggaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcgccaagggtgcgtcctaaccggcgtctgggtcatagcccacgagtgcggccaccacgccttcagcgactac

SEQ ID NO: 9124 - DNA, 334 bp, Artificial
  Mutation in BnaC.FAD2.a introduced by TALE nuclease pair BnFAD2_T01
caggatccatgggtgcaggtggaagaatgcaagtctctcctccatcccgctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgctgccaagggttcgtcctaaccggcgtctgggtcatagcccacgagtgcggccaccacgccttcagcgactac

SEQ ID NO: 9125 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaaggctgcgtcctaacgggcctctgggtcatagcccacgagtgcggccaccacgccttcagcgactac

SEQ ID NO: 9126 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgctgccaccacgccttcagcgactac

SEQ ID NO: 9127 - DNA, 343 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaacatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctccctctctactgggcctgccaagggtgcgtcctaacgggcctctgtgtcatagcccacgagtgcggccaccacgccttcagcgactac

SEQ ID NO: 9128 - DNA, 334 bp, Artificial
  Mutation in BnaC.FAD2.a introduced by TALE nuclease pair BnFAD2_T01
caggatccatgggtgcaggtggaagaatgcaagtctctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctgccaagggtgcgtcctaaccggcgtctgggtcatagcccacgagtgcggccaccacgccttcagcgactac

SEQ ID NO: 9129 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgcctccccttacttccctctcctccctccccctctctcctactcttggcctctctactgggcctgccaagggtgcgtcctaacgggcctctgggtcatcgcccacgaatgcggccaccacgccttcagcgactac

SEQ ID NO: 9130 - DNA, 446 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcagcggtggtttttttgtttgcaagcagcagattacgcgcagaaaaaaaggatctcaggtggtggccatcgccagcaatggcggtggcaagcaggcgctgcctctctactgggcctgccaagggtgcgtcctaaccggcgtctgggtcatagcccacgagtgcggccaccacgccttcagcgactac

SEQ ID NO: 9131 - DNA, 300 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagatctcaagaaagcaatcccaccgcactgtttcaaacgctcgatccctcgctctttctcctacctcatctgggacatcatcatagcctcctgcttctactacgtctctctactgggcctgccaagggtgcgtcctaaccggcgtctgggtcatagcccacgagtgcggccaccacgccttcagcgactac

SEQ ID NO: 9132 - DNA, 356 bp, Artificial
  Mutation in BnaC.FAD2.a introduced by TALE nuclease pair BnFAD2_T01
caggatccatgggtgcaggtggcagaatgcaagtgtctactccctcaaaaaagcctgaaaccgacaccatcaagcgcgtaccatgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcggccgaaccggcgtctgggtcatagcccacgagtgcggccaccacgccttcagcgactac

SEQ ID NO: 9133 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttctggcctctctactgggcctgccaagggtgcgtcctaacgggcctctgggtcatagcccacgagtgcggccaccacgccttcagcgactac

SEQ ID NO: 9134 - DNA, 349 bp, Artificial
  Mutation in BnaC.FAD2.a introduced by TALE nuclease pair BnFAD2_T01
caggatccatgggtgcaggtggcagaatgcaagtgtctcctccctccaacaagcctgaaaccgacaccatcaaacgcgtcccctgcgagacaccgcccttcactgtcggagaactcaagaaagcaatcccaccgcactgtttcaaacgctcgatccctcgctctttctcctacctcatctgggacatcatcatcccctcctccttctactacgtctccaccacttacttccctctcctccctcaccctctcacctaccttggcctctctactgggcctgccaagggtgcgtcctaacgggcgtctgggtcatagcccacgagtgcggccaccacgccttcagcgactac

SEQ ID NO: 9135 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcctctgggtcatagcccacgagtgcggccaccacgccttcagcgactac

SEQ ID NO: 9136 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaaggctgcgtcctaacgggcctctgggtcatagcccacgagtgcggccaccacgccttcagcgactac

SEQ ID NO: 9137 - DNA, 346 bp, Artificial
  Mutation in BnaC.FAD2.a introduced by TALE nuclease pair BnFAD2_T01
caggatccatgggtgcaggtggaagaatgcaagtctctcctccctccagctccctcggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctatggcctctctactgggccggccaagggtgcgtcctaacgggcctctgggtcatagcccacgagggcggccaccacgccttcagcgactac

SEQ ID NO: 9138 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctgggcctgccaagggtgcgtcctaaccggcgtctgggtcatagcccacgagtgcggccaccacgccttcagcgactac

SEQ ID NO: 9139 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccactccttcagcgactac

SEQ ID NO: 9140 - DNA, 402 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactatgtcgccaccacttacttccctctcctccctcaccctctctcctacttcgactggaaagcgggcagtgagcgcaacgcaattaatacgcgtaccgctagcctggcctctctactgggcctgccaagggtgcgtcctaaccggcgtctgggtcatagcccacgagtgcggccaccacgccttcagcgactac

SEQ ID NO: 9141 - DNA, 349 bp, Artificial
  Mutation in BnaC.FAD2.a introduced by TALE nuclease pair BnFAD2_T01
caggatccatgggtgcaggtgcaagaatgcaagtgtctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcggcctaaccggcgtctgggtcatagcccacgagtgcggccaccacgccttcagcgactac

SEQ ID NO: 9142 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttccctcgcgcctggcccctctactgggcctgccaaggctgcgtcctaacgggcctctgggtcatcgcccacgaatgcggccaccacgccttcagcgactac

SEQ ID NO: 9143 - DNA, 344 bp, Artificial
  Mutation in BnaC.FAD2.a introduced by TALE nuclease pair BnFAD2_T01
caggatccatgggtgcaggtggaagaatgcaagtgtctcctgcctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctggcctctctactgcgcctgccaagggtgcgtcctaacgggcctctgggtcatagcccacgagtgcggccaccacgccttcagcgactac

SEQ ID NO: 9144 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaaggctgcgtcctaacgggcctctgggtcatcgcccacgaatgcggccaccacgccttcagcgactac

SEQ ID NO: 9145 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaaccggcgtctgggtcatagcccacgagtgcggccaccacgcattcagcgactac

SEQ ID NO: 9146 - DNA, 300 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccaagggtgcgtcctaaccggcgtcggggtcatagcccacgagtgcggccaccacgccttcagcgactac

SEQ ID NO: 9147 - DNA, 374 bp, Artificial
  Mutation in BnaC.FAD2.a introduced by TALE nuclease pair BnFAD2_T01
caggatccatgggtgcaggtgccagaatgcaagtgtcccctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccaggcttatcttggacaagaagaagatcgctctctactgggccggccaagggttcgtcctaaccggcgtctgggtgatagcgcacgagtgcgtcctccacgccttcagcgactac

SEQ ID NO: 9148 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccttcggctctctactgggcctgccaaggctgcgtcctaacgggcctctgggtcatcgcccacgaatgcggccaccacgccttcagcgactac

SEQ ID NO: 9149 - DNA, 354 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgccctggcctctctactgggcctgccaagggtgcgtcctaatcggcgtctgggtcatagcccacgagtgcggccaccacgccttcagcgactac

SEQ ID NO: 9150 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaaggctgcgtcctaacgggcctctgggtcatagcccacgagtgcggccaccacgccttcagcgactac

SEQ ID NO: 9151 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggggcctatctactgggcctgccaagggtgcgtcctaaccggcgtctgggtcatagcccacgagtgcggccaccacgccttcagcgactac

SEQ ID NO: 9152 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggccggccaagggtgcgtcctaaccggcgtctgggtcatagcccacgagtgcggccaccacgccttcagcgactac

SEQ ID NO: 9153 - DNA, 347 bp, Artificial
  Mutation in BnaC.FAD2.a introduced by TALE nuclease pair BnFAD2_T01
caggatccatgggtgcaggtggcagaatgcaagtgtctactcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcatcgactac

SEQ ID NO: 9154 - DNA, 346 bp, Artificial
  Mutation in BnaC.FAD2.a introduced by TALE nuclease pair BnFAD2_T01
caggatccatgggtgcaggtggaagaatgaaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 9155 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggaactgccaagggtgcgtcctaaccggcgtctgggtcatagcccacgagtgcggccaccacgccttcagcgactac

SEQ ID NO: 9156 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgctgccaccacgccttcagcgactac

SEQ ID NO: 9157 - DNA, 348 bp, Artificial
  Mutation in BnaC.FAD2.a introduced by TALE nuclease pair BnFAD2_T01
caggatccatggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaatggtgcgtcctaaccggcgtctgggtcatagcccacgaatgcggccaccacgccttcagcgactac

SEQ ID NO: 9158 - DNA, 349 bp, Artificial
  Mutation in BnaC.FAD2.a introduced by TALE nuclease pair BnFAD2_T01
caggatccatgggtgcaggtggcagaatgcaagtgtctcctccctccgaaaagcctgaagccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcccctccctcaccctctcacctaccttggcctctctactgtgcctgccaagggtgcgtcctaaccggcgtctgggtcatagcccacgagtgcggccaccacgccttcagcgactac

SEQ ID NO: 9159 - DNA, 347 bp, Artificial
  Mutation in BnaC.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcttcctaacgggcctctgggtcatcgcccacgaatgcggccaccacgccttcagcgactac

SEQ ID NO: 9160 - DNA, 348 bp, Artificial
  Mutation in BnaC.FAD2.a introduced by TALE nuclease pair BnFAD2_T01
caggatccatgggtgcaggtggaataatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaaggctgcgtcctaacgggcctctgggtcataggccacgagtgcggccaccacgccttcagcgactac

SEQ ID NO: 9161 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggtcaccacgccttcagcgactac

SEQ ID NO: 9162 - DNA, 355 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccaagggtgcgtcctaaccggcgtctgggtcatagcccacgagtgcggccaccacgccttcagcgactac

SEQ ID NO: 9163 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaaccggcgtctgggtcatagcccacgagtgcggccaccacgcctgcagcgactac

SEQ ID NO: 9164 - DNA, 355 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 9165 - DNA, 347 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccgtcagcgactac

SEQ ID NO: 9166 - DNA, 333 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatcttggacatcatcatagcctcctgcttctactacgtcgccaccacttacttccctctcctccctcaccctctctaccgggcctgccaagggtgcgtcccaaagggcctccgggtcatcgcccacgaaggcggcccccccgccttcagcgactacc

SEQ ID NO: 9167 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtcctaaccggcgtctgggtcatagcccacgagtgcggccaccacgccttcagcgactac

SEQ ID NO: 9168 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtcctaaccggcgtctgggtcatagcccacgagtgcggccaccacgccttcagcgactac

SEQ ID NO: 9169 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccttggcctctctactgggcctgccaagggtgcgtcctaaccggcgtctgggtcatagcccacgagtgcggccaccacgccttcagcgactac

SEQ ID NO: 9170 - DNA, 346 bp, Artificial
  Mutation in BnaC.FAD2.a introduced by TALE nuclease pair BnFAD2_T01
caggatccatgggtgcaggtggcagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctatggcctctctactgggcctgtcaagggtgcgtcctaaccggcgtctgggtcatagcccacgagtgcggccaccacgccttcagcgactac

SEQ ID NO: 9171 - DNA, 354 bp, Artificial
  Mutation in BnaC.FAD2.a introduced by TALE nuclease pair BnFAD2_T01
caggatccatgggtgcaggtggaagaatgcaagtctctcctcactccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgccgccgggcctctctactgggcctgccaagggtgcgtcctaaccggcgtctgtgtcatagcccacgagtgcggccaccaggccttcagcgactac

SEQ ID NO: 9172 - DNA, 343 bp, Artificial
  Mutation in BnaC.FAD2.a introduced by TALE nuclease pair BnFAD2_T01
caggatccatgggtgcaggtgcaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaaggctgcgtcctaaccggcgtctgggtcatagcccacgagtgcggccaccacgccttcagcgactac

SEQ ID NO: 9173 - DNA, 351 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccaagggtgcgtcctaacgggcctctgggtcatagcccacgagtgcggccaccacgccttcagcgactac

SEQ ID NO: 9174 - DNA, 380 bp, Artificial
  Mutation in BnaC.FAD2.a introduced by TALE nuclease pair BnFAD2_T01
caggatccatgggtgcaggtggcagaatgcaagtgtctcctcccttcaagaagtctgaaaccgacaaaatcaagcgcgtacccagcgagacaccgcccttcactgtcggagaactcaagaaagcaatcccaacgcactgtttcaaacgctcgatccctcgctcttcctcctacctcatctgggacatcatcatcgcctcctgcttctactacgtcgccaccacttacttccctctccgccccccccctctgtcctacttcacagtcttccggcgcaggcgctctgaaggcctgcctctctactgggcctgccaatggtgcgtcctcaccggcgtctgcttcagagcccacgagtgcggccgccactccttcagcgactac

SEQ ID NO: 9175 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgaccgctctactgggcctgccaagggtgcgtcctaaccggcgtctgggtcatagcccacgagtgcggccaccacgccttcagcgactac

SEQ ID NO: 9176 - DNA, 332 bp, Artificial
  Mutation in BnaC.FAD2.a introduced by TALE nuclease pair BnFAD2_T01
caggatccatgggtgcaggtggcagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccatcagcgactac

SEQ ID NO: 9177 - DNA, 335 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctactgggcctgccaagggtgcgtcctaaccggcgtctgggtcatagcccacgagtgcggccaccacgccttcagcgactac

SEQ ID NO: 9178 - DNA, 351 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcggggcctctctactgggcctgccaagggtgtgtcctaaccggcgtctgggtcatagcccacgagtgcggccaccacgccttcagcgactac

SEQ ID NO: 9179 - DNA, 393 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctaacggtgcaggcgctgtggccggtgctgtgccaggcccacggcttgacccctggcctctctactgggcctgccaagggtgcgtcctaaccggcgtctgggtcatagcccacgagtgcggccaccacgccttcagcgactac

SEQ ID NO: 9180 - DNA, 338 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcctgccaaggctgcgtcctaacgggcctctgggtcatagcccacgggtgcggccaccacgccttcagcgactac

SEQ ID NO: 9181 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 9182 - DNA, 394 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccgatactgggccggcaggcgctccattgcccagtcggcagcgaggcctctctactgggcctgccaagggtgcggcctaaccggcgtctgggtcatagcccacgagtgcggccaccacgccttcagcgactac

SEQ ID NO: 9183 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcggctctctactgggcctgccaaggctgcgtcctaacgggcctctgggtcatcgcccacgaatgcggccaccacgccttcagcgactac

SEQ ID NO: 9184 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccttcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 9185 - DNA, 351 bp, Artificial
  Mutation in BnaC.FAD2.a introduced by TALE nuclease pair BnFAD2_T01
caggatccatgggtgcaggtggaagaatgcaagtgtctactcactccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaaccggcgtctgtgtgatagcccacgagtgcggccaccacgccttcagcgactac

SEQ ID NO: 9186 - DNA, 348 bp, Artificial
  Mutation in BnaC.FAD2.a introduced by TALE nuclease pair BnFAD2_T01
caggatccatgggtgcaggtgggagaatgcaagtctctcctccatcccagaagtctgaaaccgacaccatcaagcgcgtaccctgtgagataccgcccttcactgtcggagaactcaagaaagcactcccacctcactgtttcaaacgctcgatccctcgctctttctcctacctcatctgggacatcatcatagcctcctgcttctactacgtcgccaccacttacttccctctcctccctcaccctctctcctacttggcctctctactgtgcctgccaagggtgcgtcctaaccggcgtctgggtcagagcccacgagtgcggccaccacgccatcagcgactac

SEQ ID NO: 9187 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaaggctgcgtcctaaccggcgtctgggtcatagcccacgagtgcggccaccacgccttcagcgactac

SEQ ID NO: 9188 - DNA, 342 bp, Artificial
  Mutation in BnaC.FAD2.a introduced by TALE nuclease pair BnFAD2_T01
caggatccatgggtgcaggtggaagaatgcaagtgtctcatccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgtctctctactgggcctgccaagggtgcgtcctaaccggcgtctgggtcatagcccacgagtgcggccaccacgccttcagcgactac

SEQ ID NO: 9189 - DNA, 356 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 9190 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctgcctctctactgggcctgccaagggtgcgtcctaaccggcgtctgggtcatagcccacgagtgcggccaccacgccttcagcgactac

SEQ ID NO: 9191 - DNA, 277 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacgtccctctcctccctcaccctctctccgacttcacgccttcagcgactac

SEQ ID NO: 9192 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactggtcctgccaagggtgcgtcctaaccggcgtctgggtcatagcccacgagggcggccaccacgcctgcagcgactac

SEQ ID NO: 9193 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtccttgcccacgagtgcggccaccccgccttcagcgactacc

SEQ ID NO: 9194 - DNA, 348 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccgcctggcctctctactgggcctgccaagggtgcgtcctaaccggcgtctgggtcatagcccacgagtgcggccaccacgccttcagcgactac

SEQ ID NO: 9195 - DNA, 350 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatcgcctcctgcttctactacgtcgccaccacttacttccctctcctccctcaccctctctcctcctccaggcctctctactgggcctgccaaggctgcggccgaacgggcctctgggtcatagcccacgagtgcggccaccacgcctgcagcgactac

SEQ ID NO: 9196 - DNA, 351 bp, Artificial
  Mutation in BnaC.FAD2.a introduced by TALE nuclease pair BnFAD2_T01
caggatccatgggtgcagggggaagaatgcaagtgtctcctgcctccaagaagtctgaaaccgacaccatcaagcgcgtaccctgcgagacaccgccgttcactgtcggagaactcaagaaagcaatcccaccgcactgtttcaaacgctcgatccctcgctctttctcctacctcatctgggacatcatcatagcctcctgcttctactacgtcgccaccacttacatccctctcctccctcaccctctctcctacgtcctggcctctctactgggcctgccaaggttgcgtcctaaccggcgtctgggtcatagcccacgagtgcggccaccacgccttcagcgactac

SEQ ID NO: 9197 - DNA, 356 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactacgccgcctggcctctctactgggcctgccaagggtgcgtcctaaccggcgtctgggtcatagccctcgacttcggccaccacgccttcagccactac

SEQ ID NO: 9198 - DNA, 438 bp, Artificial
  Mutation in BnaC.FAD2.a introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttaatgtttaactttgttttatggcgactcccctgctgcgtaacatcgttgctggacatcatcgatatcgccgatctacgcacgctcgacctggcctctctactgggcctgccaagggtgcgtcctaaccggcgtctgtgtcatatcccgcgagtgcggccaccacgccttcaccgactac

SEQ ID NO: 9199 - DNA, 329 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacgccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgccaagggtgcgtcctaaccggcgtctgggtcatagcccacgagtgcggccaccacgccttcagcgactac

SEQ ID NO: 9200 - DNA, 344 bp, Artificial
  Mutation in BnaC.FAD2.a introduced by TALE nuclease pair BnFAD2_T01
caggatccatgggtgcaggtgcaagaatgcaagtgtctcctccctccaagaagactgaacccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcttggcctctctactgggcctgccaagggtgcgtcctaaccggcgtctgggtcatagcccacgagggcggccaccacgcctgcagcgactac

SEQ ID NO: 9201 - DNA, 344 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctccttcggctctctactgggcctgccaagggtgcgtcctaaccggcgtctgggtcatagcccacgagtgcggccaccacgccttcgcgactac

SEQ ID NO: 9202 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagactgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctccagcttctactacgtcgccaccacttacttccctctcctccctcaccctctctccgactttggcctctctactgggcctgccaagggtgcgtcctaaccggcgtctgggtcatagcccacgagtgcggccaccacgccttcagcgactac

SEQ ID NO: 9203 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcggcctctctactgggcctgccaagggtgcgtcctaaccggcgtctgggtcatagcccacgagtgcggccaccacgccttcagcgactac

SEQ ID NO: 9204 - DNA, 323 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagggtgcgtcctaaccggcgtctgggtcatagcccacgagtgctgccaccacgccttcagcgactac

SEQ ID NO: 9205 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaacctctcccttaccactctactgggcctgccaaggctgcgtcctaacgggcctctgggtcatagcccacgaatgcggccaccacgccttcagcgactac

SEQ ID NO: 9206 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccgtcgcccctggcctctctactgggcctgccaagggtgcgtcctaacgggcctctgggtcatcgcccacgaatgcggccaccacgccttcagcgactac

SEQ ID NO: 9207 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccctcactgtcggagaactcaagaaagcaatcccaccgcactgtttcaaacgctcgctccctcgctctttctcctacctcatctgggacatcatcatagcctcctgcttctactacgtcgccaccacttacttccctctcctccctcgccctctcccctagcctctctactgggcctgccatgggtgcgtcctaaccggcgtctgggtcatagcccacgagtgcggcgaccacgccttcagcgactat

SEQ ID NO: 9208 - DNA, 378 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctccagcccctgcttgccgccatcgtggctggcgatggccaccacctgctccggggtcaagccgtgagggctgggtcatagcccacgagtgcggccaccacgccttcagcgactac

SEQ ID NO: 9209 - DNA, 350 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccaggagtgcggccaccacgcctgcagcgactac

SEQ ID NO: 9210 - DNA, 349 bp, Artificial
  Mutation in BnaC.FAD2.a introduced by TALE nuclease pair BnFAD2_T01
caggatccatgggtgcaggtggaagaatgaaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 9211 - DNA, 387 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgccatcgtggctggcgatggccaccacctgcgcctggcctctctactgggcctgccaagggtgcgtcctaaccggcgtctgggtcatagcccacgagtgcggccaccacgccttcagcgactac

SEQ ID NO: 9212 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccacccttcactgtcggagaactcaagaaagcaatcccaccgcactgtttcaaacgctccatccctcgctccttctcctacctcatctgggacatcatcataccctcctgcttctactccgtccccaccaccttcttccctcccctccctcaccctctcccggcctctctactgggcctgccaaggctgcgtcctaaccggcgtctgggtcatagcccacgagtgcggccaccacgccttcagcgactac

SEQ ID NO: 9213 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaaccggcgtctgggtcatagcccacgagtgcggccaccacgccttcagcgactac

SEQ ID NO: 9214 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagactgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 9215 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctctggcccctctactgggcctgccaaggctgcgtcctaaccggcgtcttggtcatagcccacgagtgcggccaccacgccttcagcgactac

SEQ ID NO: 9216 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgtcctaaccggcgtctgggtcatagccaactagtgcggccaccacgccttcagcgactac

SEQ ID NO: 9217 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 9218 - DNA, 332 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggaactgccaagggtgcgtcctaaccggcgtctgggtcatagcccacgagtgcggccaccacgccttcagcgactac

SEQ ID NO: 9219 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctagcctctctactggacctgccaagggtgcgtcctaaccggcgtctgggtcatagcccacgagtgcggccaccacgccttcagcgactac

SEQ ID NO: 9220 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaacgggcctctgggtcatcgcccaccaatgcggccaccacgccttcagcgactac

SEQ ID NO: 9221 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcaatgtttcaaacgctcgatccctcgctctttctcctacctcatctcgcacatcatcatagcctcctgattctactaccccgcccccacttacttccctctcctccctcaccctctcccccacgtccctctactgggcctgccaagggtgcgtcctaaccggcgtctgggtcatagcccacgagtgcggccaccacgccttcagcgactac

SEQ ID NO: 9222 - DNA, 356 bp, Artificial
  Mutation in BnaC.FAD2.a introduced by TALE nuclease pair BnFAD2_T01
caggatccatgggtgcaggtgccagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 9223 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggctgtgtcctaacgggcctctgggtcatagcccacgagtgcggccaccacgccttcagcgactac

SEQ ID NO: 9224 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgtggcctctctactgggcctgccaagggtgcggcctaaccggcgtcggggtcatagcccacgagtgcggccaccacgccttcagcgactac

SEQ ID NO: 9225 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgtggcctctctactgggcctgccaagggtgcgtcctaaccggcgtctgggtcatagattaagagtgcggccaccaccccttcagcgactag

SEQ ID NO: 9226 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcatacctcatctgggacatcatcatagcctcctgcttctactacgtcgccaccacttacttccctctcctccctcaccctctctcctggaactgccaagggtgcgtcctaaccggcgtctgggtcatatcttaccagtgcggccaccaccccttccgcgactgc

SEQ ID NO: 9227 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccaagggtgcgtcctaaccggcgtctgggtcatagcccacgagtgcggccaccacgccttcagcgactac

SEQ ID NO: 9228 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 9229 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatggcctctctactgggcctgccaagggtgcgtcctaaccggcgtctgggtcatagcccacgagttcggccaccacgccttcagcgactac

SEQ ID NO: 9230 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccaagggtgcgtcctaaccggcgtctgagtcatagcccacgagtgcggccaccacgccttcagcgactac

SEQ ID NO: 9231 - DNA, 401 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccataaactgccaggcatcaaactaagcagaaggccatccgtccataggctggcctctctactgggcctgccaagggtgcgtcctaacgggcctctgggtcatcgcccacgaatgcggccaccacgccttcagcgactac

SEQ ID NO: 9232 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 9233 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctccactgggcctgccaagggtgcgtcctaaccggcgtctgggtcatagcccacgagtgcggccaccacgccttcagcgactac

SEQ ID NO: 9234 - DNA, 344 bp, Artificial
  Mutation in BnaC.FAD2.a introduced by TALE nuclease pair BnFAD2_T01
caggatccatgggtgcaggtggaagaatgcaagtgtatactcactccaagaagcctgaaaccgacaccatcaagcgagtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgcctgcagcgactac

SEQ ID NO: 9235 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaacgggcctctgggtcatagcccacgagtgcggccaccacgccttcagcgactac

SEQ ID NO: 9236 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttggcctctctactgggcctgccaagggtgcgtcctaaccggcgtctgggtcatagcccacgagtgcggccaccacgccttcagcgactac

SEQ ID NO: 9237 - DNA, 344 bp, Artificial
  Mutation in BnaC.FAD2.a introduced by TALE nuclease pair BnFAD2_T01
caggatccatgggtgcaggtgcaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaagggtgcgtcctaaccggcgtctgggtcatagcccacgagtgcggccaccacgccttcagcgactac

SEQ ID NO: 9238 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaactctgaaaccgacaccatcaagcgcgtaccctgcgagacaccgcccttcactgtcggagaactcaagaaagcaatcccaccgcactgtttcaaacgctcgatccctcgctctttctcctacctaatctgggacatcatcatagcctcctgcttctactacgtcaccaccacttacttccctctcctccctcaccctctctccgattggcctctctactgggcctgccaagggtgcgtcctaaccggcgtctgggtcatagcccacgagtgcggccaccacgccttcagcgactac

SEQ ID NO: 9239 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaacctacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaagggtgcgtcctaaccggcgtctgggtcatagcccacgagtgcggccaccacgccttcagcgactac

SEQ ID NO: 9240 - DNA, 355 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 9241 - DNA, 341 bp, Artificial
  Mutation in BnaC.FAD2.a introduced by TALE nuclease pair BnFAD2_T01
caggatccatgggtgcaggtggcagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 9242 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctccgaccctggcctctctactgggcctgccaagggtgcgtcctaaccggcgtctggggcatagcccacgagtgcggccaccacgccttcagcgactac

SEQ ID NO: 9243 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagaccccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcgcctggcctctctactgggcctgccaagggtgcgtcctaaccggcgtctgggtcatagcccacgagtgcggccaccacgccttcagcgactac

SEQ ID NO: 9244 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgcttcaaacgctccatcccacgctccttctcctcttcgacatcatcatctcctcctcggctcctccctctaccacctctccacagcctacttccctctcctccctcaccctctctcctatggcctctctactgggcctgccaagggtgcgtcctaaccggcgtctgggtcatagcccacgagtgcggccaccacgccttcagcgactac

SEQ ID NO: 9245 - DNA, 351 bp, Artificial
  Mutation in BnaC.FAD2.a introduced by TALE nuclease pair BnFAD2_T01
caggatccatgggtgcatgtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctccctcctacttcgcggcctctctactgggcctgccaagggtgcgtcctaaccggcgtctgggtcatagcccacgagtgcggccaccacgccttcagcgactac

SEQ ID NO: 9246 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtctggcctctctactgggcctgccaagggtgcgtcctaaccggcgtctgggtcatagcccacgagtgcggccaccacgccttcagcgactac

SEQ ID NO: 9247 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatcgcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 9248 - DNA, 341 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctctactgggcctgccaagggtgcgtcctaaccggcgtctgggtcatagcccacgagtgcggccaccacgccttcagcgactac

SEQ ID NO: 9249 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcattgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctccactgggcctgccaagggtgcgtcctaaccggcgtctgggtcatagtccacgagtgcggccaccacgccttcagcgactac

SEQ ID NO: 9250 - DNA, 324 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcttgccaagggtgcgtcctaaccggcgtctgggtcatagcccacgagtgcggccaccacgccttcagcgactac

SEQ ID NO: 9251 - DNA, 349 bp, Artificial
  Mutation in BnaC.FAD2.a introduced by TALE nuclease pair BnFAD2_T01
caggatccatgggtgcaggtggaagaatgtaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtcctaaccggcgtctgggtcatagcccacgagtgcggccaccacgccttcagcgactac

SEQ ID NO: 9252 - DNA, 332 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactgcgtcgccaccacttacttccctctcctccctcaccctctctcctgggcctgccaagggtgcgtcctaaccggcgtctgggtcatagcccacgagtgcggccaccacgccttcagcgactac

SEQ ID NO: 9253 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcgtccaccacgccttcagcgactac

SEQ ID NO: 9254 - DNA, 347 bp, Artificial
  Mutation in BnaC.FAD2.a introduced by TALE nuclease pair BnFAD2_T01
caggatccatgggtgcaggtggaagaatgcaagtctctcctccctccagctccccggaaaccaaacccttcaaacgggtcccctgcgagacaccccccttcactctcgaagacctcaagaaagcaatcccaccgcactgtttcacacgctcgatccctcgctctttctcctacctcatctgggacatcatcatagcctcctgcttctactacgtcgccaccacttacttccctctcctccctcaccctctctcctacttgcctctctactgggcctgccaaggctgcgtcctaacgggcctctgggtcatagcccacgagtgcggccaccacgccttcagcgactac

SEQ ID NO: 9255 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggaactgccaagggtgcgtcctaacgggcctctgggtcatcgcccacgaatgcggccaccacgccttcagcgactac

SEQ ID NO: 9256 - DNA, 347 bp, Artificial
  Mutation in BnaC.FAD2.a introduced by TALE nuclease pair BnFAD2_T01
caggatccatgggtgcaggtggaagaatgcaagtgtatactcactccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 9257 - DNA, 349 bp, Artificial
  Mutation in BnaC.FAD2.a introduced by TALE nuclease pair BnFAD2_T01
caggatccatgggtgcaggtgaaagaatgcaagtctctactccctccaagaagcctgaaaccgacaccatcaagcgcgtaccctgcgagacaccgcccttcactgtcggacaactcaagaaagcaatcccaccgcactgtttcaaacgctccatccctcgctctttctcctccctcatctgggacatcatcatagcctcctgcttctaccacctctccacggcctacttccctctcctcccccaccctctcccttcccttggcccctctactgggcctgccaaggctgcggcctaacgggcctctgggtcatcgcccacgaatgcggccaccacgccttcagcgactac

SEQ ID NO: 9258 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgttccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 9259 - DNA, 339 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgtgtcatagcccacgagtgcggccaccacgccttcagcgactac

SEQ ID NO: 9260 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatcgcccacgaatgcggccaccacgccttcagcgactac

SEQ ID NO: 9261 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctactttggcctctctactgggcctgccaagggtgcgtcctaaccggcgtctgggtcatagcccacgagtgcggccaccacgccttcagcgactac

SEQ ID NO: 9262 - DNA, 385 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccgtgggcctgccacggcaccggcaacagccgctggaccgtctccagcgcctgcctggcctctctactgggcctgccaagggtgcgtcctaaccggcgtctgggtcatagcccacgagtgcggccaccacgccttcagcgactac

SEQ ID NO: 9263 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgtttcaaacgctcgatccctcgctctttctcctacctcatctgggacatcatcatagcctcctgcttctactacgtcgccaccacttacttccctctcctcccccaccctctctcctacttctggcctctctactgggcctgccaagggtgcgtcctaaccggcgtctgggtcatagcccacgagtgcggccaccacgccttcagcgactac

SEQ ID NO: 9264 - DNA, 398 bp, Artificial
  Mutation in BnaC.FAD2.a introduced by TALE nuclease pair BnFAD2_T01
caggatccatgggtgcaggtggcagaatgcaagtctctcctccctccagctcccccggaaccaacaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctgccaacttctcaagattgcaaaacgtggcggcgtgaccgcagtggaggcagtgcatgcgcctctctactgggcctgccaagggtgcgtcctaaccggcgtctgggtcatagcccacgagtgcggccaccacgccttcagcgactac

SEQ ID NO: 9265 - DNA, 343 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccagcctctctactgggcgtgccaagggtgcgtcctaagcggcgtctgggtcatagcccacgagtgcggccaccacgcctgcagcgactac

SEQ ID NO: 9266 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactttggcccctctactgggcctgccaagggtgcgtcctaaccggcgtctgggtcatagcccacgagtgcggccaccacgccttcagcgactac

SEQ ID NO: 9267 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaacgggcctctgggtcatagcccacgagtgcggccaccacgccttcagcgactac

SEQ ID NO: 9268 - DNA, 386 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggccaccacctgctggggggtcaagccgtgggcctggcacagtctctactgggcctgccaagggtgcgtcctaaccggcgtctgggtcatagcccacgagtgcggccaccacgccttcagcgactac

SEQ ID NO: 9269 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtcttaaaccgacaccatcaagcgcgtaccctgcgagacaccgcccttcactgtcggagaactcaagaaagcaatcccaccgcactgtttcaaacgctcgatccctcgctctttctcctacctcatctggggcatcatcatagcctcctgcttctactacgtcgccaccacttacttccctctcctccctcaccctctctcctacttagcctgccaagggtgcgtcctaaccggcgtctgggtcatagcccacgagtgcggccaccacgccttcagcgactac

SEQ ID NO: 9270 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctcccccatctggcacatcatcctagcctcctgcttctcctccgtcgcccccactttcttccctctcctccctcaccccctctcccgcttcgcctttggcctctctactgggcctgccaagggtgcgtcctaaccggcgtctgggtcatagcccacgagtgcggccaccacgccttcagcgactac

SEQ ID NO: 9271 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaacgggcctctgggtcatcgcccacgaatgcggccaccacgccttcagcgactac

SEQ ID NO: 9272 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctagcctctctactggacctgccaagggtgcgtcctaaccggcgtctgggtcatagcccacgagtgcggccaccacgccttcagcgactac

SEQ ID NO: 9273 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccaaggctgcgtcctaacgggcctctgggtcatagcccacgagtgcggccaccacgccttcagcgactac

SEQ ID NO: 9274 - DNA, 383 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcagcggctgttgccggtgctgtgccaggcccacggtttctctctactgggcctgccaagggtgcgtcctaaccggcgtctgggtcatagcccacgagtgcggccaccacgccttcagcgactac

SEQ ID NO: 9275 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctggcctctctactgggcctgccaagggtgcgtcctaaccggcgtctgggtcatagcccacgagtgcggccaccacgccttcagcgactac

SEQ ID NO: 9276 - DNA, 351 bp, Artificial
  Mutation in BnaC.FAD2.a introduced by TALE nuclease pair BnFAD2_T01
caggatccatgggtgcaggttgaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgaggcctctctactgggcctgccaagggtgcgtcctaaccggcgtctgggtcatagcccacgagtgcggccaccacgccttcagcgactac

SEQ ID NO: 9277 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaattccaccgcactgtttcaaacgctcgatccctcgctctttctcctacctcatctgggacatcatcatagcctcctgcttctactacgtagccaccacttacttccctctcctccctcaccctctctcctacatggcctctctactgggcctgccaagggtgcgtcctaaccggcgtctgggtcatagcccacgagtgcggccaccacgccttcagcgactac

SEQ ID NO: 9278 - DNA, 349 bp, Artificial
  Mutation in BnaC.FAD2.a introduced by TALE nuclease pair BnFAD2_T01
caggatccatgggtgcaggtggaagaatgcaagtctctactccctccagctcccccgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 9279 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccatctcctccctcaccctctctactgggcctgccaagggtgcgtcctaaccggcgtctgggtcatagcccacgagtgcggccaccacgccttcagcgactac

SEQ ID NO: 9280 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatcgcccacgaatgcggccaccacgccttcagcgactac

SEQ ID NO: 9281 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaaggctgcgtcctaacgggcctctgggtcatagcccacgagtgcggccaccacgccttcagcgactac

SEQ ID NO: 9282 - DNA, 332 bp, Artificial
  Mutation in BnaC.FAD2.a introduced by TALE nuclease pair BnFAD2_T01
caggatccatgggtgcaggtggaagaatgcaagtgtatcctccctccaagaagactgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggaactgccaagggtgcgtcctagccggcgtctgggtcatagcccacgagtgcggccaccacgccttcagcgactac

SEQ ID NO: 9283 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcatctgggacatcatcatagcctcctgcttctactacgtcgccaccacttacttccctctcctccctcaccctctcccttacctctggcccctctactgggcctgccaaggcggcgtcctaacgggcctctgggtcatcgcccacgaatgcggccaccacgcctgcagcgactac

SEQ ID NO: 9284 - DNA, 393 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgacccctcgctctttctcctacctcatctgggacatcatcatagcctcctgcttctactacgtcgccaccacttacttccctctcctccctcaccctctctaacggtgcaggcgctgttgccggtgctgtcccaggcccacggcttgacccctggcctctctactgggcctgccaagggtgcgtcctaacgggcctctgggtcatcgcccacgaatgcggccaccacgccttcagcgactac

SEQ ID NO: 9285 - DNA, 332 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaaccggcgtctgggtcatagcccacgagtgcggccaccacgccttcagcgactac

SEQ ID NO: 9286 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccaagggtgcgtcctaaccggcgtctgggtcatagcccacgagtgcggccaccacgccttcgcgactac

SEQ ID NO: 9287 - DNA, 348 bp, Artificial
  Mutation in BnaC.FAD2.a introduced by TALE nuclease pair BnFAD2_T01
caggatccatgtgtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 9288 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccgtcccgcccctctactgggcctgccaaggctgcgtcctaacgggcctctgggtcatcgcccacgaatgcggccaccacgccttcagcgactac

SEQ ID NO: 9289 - DNA, 348 bp, Artificial
  Mutation in BnaC.FAD2.a introduced by TALE nuclease pair BnFAD2_T01
caggatccatgggtgcagggggaagaatgcaagtgtatccgccctccaagaagtctgaaaccgacaccatcaagcgagtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactcggcctgccaagggtgcgtcctaaccggcgtctgggtcatagcccacgagtgcggccaccacgccttcagcgactac

SEQ ID NO: 9290 - DNA, 343 bp, Artificial
  Mutation in BnaC.FAD2.a introduced by TALE nuclease pair BnFAD2_T01
caggatccatgggtgcaggtggaagaatgcaagtgtatcctccccccaagaggtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtgctaaccggcgtctgggtcatagcccaccagtgcggccagcacgccttcagcgactac

SEQ ID NO: 9291 - DNA, 401 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcggtccagcgcctgcttgccaccattattgctggcgatggccaccacctgctgggcctctctactgggcctgccaagggtgcgtcctaaccggcgtctgggtcatagcccacgagtgcggccaccacgccttcagcgactac

SEQ ID NO: 9292 - DNA, 348 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagcgtgcgtcctaaccggcgtctgggtcatagcccacgagtgcggccaccacgccttcagcgactac

SEQ ID NO: 9293 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgcctcagcgactac

SEQ ID NO: 9294 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccatgggtgcgtcctaaccggcgtctgggtcatagcccacgagtgcggccaccacgcctgcagcgactac

SEQ ID NO: 9295 - DNA, 351 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccaagggtgcgtcctaaccggcgtctgggtcatagcccacgagtgcggccaccacgccttcagcgactac

SEQ ID NO: 9296 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtctggcctctctactgggcctgccaagggtgcgtcctaaccggcgtctgggtcatagcccacgagtgcggccaccacgccttcagcgactac

SEQ ID NO: 9297 - DNA, 277 bp, Artificial
  Mutation in BnaC.FAD2.a introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcacaccgcactgtttcaaacgctcgatccctcgctctttctcctacctcatctgggacatcatcatagcctcctgcttctactacgtcgccaccacttacttccctctcctccctcaccctctctcctacttcacgccttcagcgactac

SEQ ID NO: 9298 - DNA, 349 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcggcctaaccggcgtctgggtcatagcccacgagtgcggccaccacgccttcagcgactac

SEQ ID NO: 9299 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccatgggtgcatcttaaccggcgtctgggtcatagcccacgagtgcggccaccacgccttcagcgactac

SEQ ID NO: 9300 - DNA, 405 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttcgcaatgcactgacgggtgccccgctcaacttgaccccccagcaggtggtggccatcggcctctctactgggcctgccaagggtgcgtcctaaccggcgtctgggtcatagcccacgagtgcggccaccacgccttcagcgactac

SEQ ID NO: 9301 - DNA, 355 bp, Artificial
  Mutation in BnaC.FAD2.a introduced by TALE nuclease pair BnFAD2_T01
caggatccatgggtgcaggtggaagaatgcaagtgtctcctcactccaagaagtctgaaaccgacaacatcaagcgcgtaccctgcgagacagcgcccttcactgtcggagaactcaagaaagcaatcccaccgcactgtttcaaacgctcgatccctcgcactttctcctacctcatctgggacatcatcatagcctcctgcttctactacgtcgccaccacttgcttccctctcctccctcaccccctctcctgcgtcgcccctagcctctctcctgggcgttccaagggtgcgtcttaaccggcgtctgggtcatagctcagaagtgcggccaccgcgccttcagcgactac

SEQ ID NO: 9302 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttaccccctctactgggcctgccaaggctgcgtcctaacgggcctctgggtcatcgcccacgaatgcggccaccacgccttcagcgactac

SEQ ID NO: 9303 - DNA, 343 bp, Artificial
  Mutation in BnaC.FAD2.a introduced by TALE nuclease pair BnFAD2_T01
caggatccatgggtgcaggtggaagaatgcaagtgtatcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaacgggcctctgggtcatcgcccacgagtgcggccaccacgccttcagcgactac

SEQ ID NO: 9304 - DNA, 405 bp, Artificial
  Mutation in BnaC.FAD2.a introduced by TALE nuclease pair BnFAD2_T01
caggatccatgggtgcaggtggaagaatgcaagggtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcgcaatgcactgacgggtgccccgctcaacttgaccccccagcaggtggtggccatcggcctctctactgggcctgccaagggtgcgtcctaaccggcgtctgggtcatagcccacgagtgcggccaccacgccttcagcgactac

SEQ ID NO: 9305 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacgtcatcatagcctcctgcttctactacgtcgccaccacttacttccctctcctccctcaccctctctcctacttctgggcctctctactgggcctgccaagggtgcgtcctaaccggcgtctgggtcatagcccacgagtgcggccaccacgccttcagcgactac

SEQ ID NO: 9306 - DNA, 345 bp, Artificial
  Mutation in BnaC.FAD2.a introduced by TALE nuclease pair BnFAD2_T01
caggatccatgggtgcaggtggaagaatgcaagtctctcctcactccagctcccccgaaaccaaaccctcaaacgcgtcccctgcgagacaccacccttcactctcggagacctcaggaaagcaatcccacctcactgcttcaaacgctccatccctcgctctttctcctacctcatctgggacatcatcatagcctcctgcttctactacgtcgccaccacttacttccctctcctccctcaccctctctcctacttcctctctactgggcctgccaagggtgcgtcctaacgggcctctgggtcatagcccacgagtgcggccaccacgccttcagcgactac

SEQ ID NO: 9307 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctcctccgcccgcctggcctctctactgggcctgccaagggtgcgtcctaaccggcgtctgggtcatagcccacgagtgcggccaccacgccttcagcgactac

SEQ ID NO: 9308 - DNA, 310 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctcaccctctctcctactcgcctctctactgggcctgccaaggctgcgtcctaacgggcctctgggtcatagcccacgagtgcggccaccacgccttcagcgactac

SEQ ID NO: 9309 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtccgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 9310 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttacctctctactgggcctgccaagggtgcgtcctaaccggcgtctgggtcatagcccacgagtgcggccaccacgccttcagcgactac

SEQ ID NO: 9311 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 9312 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgctctgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 9313 - DNA, 332 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaaccggcgtctgggtcatagcccacgagtgcggccaccacgccttcagcgactac

SEQ ID NO: 9314 - DNA, 344 bp, Artificial
  Mutation in BnaC.FAD2.a introduced by TALE nuclease pair BnFAD2_T01
caggatcgatgggtgcaggtggaagaatgcaagtctctcctccctccagctcccccggaaccaacaccctcaaacgcgtcccatgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 9315 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagccaccgcccttcactgtcggagaactcaagaaagcaatcccaccgcactgtttcaaacgctcgatccctcgctctttctcctacctcatctggaacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 9316 - DNA, 343 bp, Artificial
  Mutation in BnaC.FAD2.a introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 9317 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttcctctctactgggcctgccaagggtgcggcctaaccggcgtcggggtcatagcccacgagtgcggccaccacgccttcagcgactac

SEQ ID NO: 9318 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgttccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcgcaccagtgcggccaccacgcctgctgcgactac

SEQ ID NO: 9319 - DNA, 338 bp, Artificial
  Mutation in BnaC.FAD2.a introduced by TALE nuclease pair BnFAD2_T01
caggatccatgggtgcaggtggaagaatgcaagtgtcccctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaagggtgcgtcctaaccggcgtctgggtcatagcccacgagtgcgtccaccacgccttcagcgactac

SEQ ID NO: 9320 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagccaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaaggcggcgtcctaaccggcgtctgggtcatagcccacgagtgcggccaccacgccttcagcgactac

SEQ ID NO: 9321 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctctactgggcctgccaagggtgcgtcctaacgggcctctgggtcatagcccacgagtgcggccaccacgccttcagcgactac

SEQ ID NO: 9322 - DNA, 374 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccaggcatatctttgacaagaagaagatcgctctctactgggcctgccaagggtgcgtcctaaccggcgtctgggtcatagcccacgagtgcggccaccacgccttcagcgactac

SEQ ID NO: 9323 - DNA, 347 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttacctctctactgggcctgccaagggtgcgtcctaaccggcgtctgggtcatagcccacgagtgcggccaccacgccttcagcgactac

SEQ ID NO: 9324 - DNA, 324 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccacaacttacttccctctcctccctcaccctctcttgccaagggtgcgtcctaaccggcgtctgggtcatcgcccacgaatgcggccaccacgccttcagcgactac

SEQ ID NO: 9325 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgtgtcctaaccggcgtctgggtcatagcccacgagtgcggccaccacgccttcagcgactac

SEQ ID NO: 9326 - DNA, 348 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgcctgcagcgactac

SEQ ID NO: 9327 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 9328 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctaccaagggtgcgtcctaaccggcgtctgggtcatagcccacgagtgcggccaccacgccttcagcgactac

SEQ ID NO: 9329 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctacttcgtcgccaccacttacttccctctcctccctcaccctctctcctacttcgtggcctctctactgggcctgccaagggtgcgtcctaaccggcgtctgggtcatagcccacgagtgcggccaccacgccttcagcgactac

SEQ ID NO: 9330 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgctggcctctctactgggcctgccaagggggcggcctaaccggcgtctgggtcatagcccacgagggcggccaccacgccttcagcgactac

SEQ ID NO: 9331 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctatggcctctctactgggcctgccaagggtgcgtcctaaccggcgtctgggtcatagcccacgagtgcggccaccacgccttcagcgactac

SEQ ID NO: 9332 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaacctgcgtctgggtcatagcccacgagtgcggccaccacgccttcagcgactac

SEQ ID NO: 9333 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctccctcatctgggacatcatcctagcctcctgcttctactacgtcccccccacttacttccctctcctccctcaccccctctcccacctggcctctctactgggcctgccaagggtgcgtcctaaccggcgtctgggtcatagcccacgagtgcggccaccacgccttcagcgactac

SEQ ID NO: 9334 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggtgcctggcctctctactgggcctgccaagggtgcgtcctaacgggcctctgggtcatagcccacgagtgcggccaccacgccttcagcgactac

SEQ ID NO: 9335 - DNA, 312 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 9336 - DNA, 356 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaaggctgcgtcctaacgggcctctgggtcatagcccacgagtgcggccaccacgccttcagcgactac

SEQ ID NO: 9337 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgcctgcagcgactac

SEQ ID NO: 9338 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccgctggcctctctactgggcctgccaaggctgcgtcctaacgggcctctgggtcatcgcccacgaatgcggccaccacgccttcagcgactac

SEQ ID NO: 9339 - DNA, 339 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaacgggcctctgggtcatagcccacgagtgcggccaccacgccttcagcgactac

SEQ ID NO: 9340 - DNA, 321 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaacgggcctctgggtcatagcccacgagtgcggccacaacgccttcagcgactac

SEQ ID NO: 9341 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatggcccacgagtgcggccaccacgccttcagcgactac

SEQ ID NO: 9342 - DNA, 345 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcaccctctctcctactttggcctctctactgggcctgccaagggtgcgtcctaaccggcgtctgggtcatagcccacgagtgcggccaccacgccttcagcgactac

SEQ ID NO: 9343 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcttctctactgggcctgccaagggtgcgtcctaaccggcgtctgggtcatagcccacgagtgcggccaccacgccttcagcgactac

SEQ ID NO: 9344 - DNA, 351 bp, Artificial
  Mutation in BnaC.FAD2.a introduced by TALE nuclease pair BnFAD2_T01
caggatccatgggtgcaggtggaagaatgcaagtctctcctccctccaaaaagactgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcctctctactgggcctgccaagggtgcggcctaaccggcgtctgggtcatagcccacgagtgcggccaccacgccttcagcgactac

SEQ ID NO: 9345 - DNA, 349 bp, Artificial
  Mutation in BnaC.FAD2.a introduced by TALE nuclease pair BnFAD2_T01
caggtccatgggtgcaggtggaagaatgcaagtctctcctccctccagctcccccgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 9346 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctccgccctcaccctctcgcctacggcctctctactgggcctgccaagggcgcggcctaaccggcgtctgggtcatagcccagaagtgcggccaccgcgcctgcagcgactac

SEQ ID NO: 9347 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtcttaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 9348 - DNA, 337 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctactgggcctgccaagggtgcggcctaaccggcgtctgggtcatagcccacgagtgcggccaccacgccttcagcgactac

SEQ ID NO: 9349 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatggcctctctactgggcctgccaagggtgcgtcctaaccggcgtctgggtcatagcccacgagtgcggccaccacgccttcagcgactac

SEQ ID NO: 9350 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtccactgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactggtcctgccaagggtgcgtcctaaccggcgtctgggtcatagcccacgagttcggccaccacgccttcagcgactac

SEQ ID NO: 9351 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccacaacttacttccctctcctccctcaccctctctcctacttctctactgggcctgccaagggtgcgtcctaaccggcgtctgggtcatagcccacgagtgcggccaccacgccttcagcgactac

SEQ ID NO: 9352 - DNA, 434 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcggctgttgctggtgctgtgccaggcccacggcttgaccccccagcaggtggtggccatcgccagcaatggcggtggcaagcaggcgctggaggcctggcctctctactgggcctgccaagggtgcgtcctaaccggcgtctgggtcatagcccacgagtgcggccaccacgccttcagcgactac

SEQ ID NO: 9353 - DNA, 339 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccaagggtgcgtcctaacgggcctctgggtcatagcccacgagtgcggccaccacgccttcagcgactac

SEQ ID NO: 9354 - DNA, 344 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactggacctgccaagggtgcgtcctaaccggcgtctgggtcatagcccacgagtgcggccaccacgccttcagcgactac

SEQ ID NO: 9355 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaactctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 9356 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctggcccctctactgggcctgccaaggctgcgtcctaacgggcctctgggtcatagcccacgagtgcggccaccacgccttcagcgactac

SEQ ID NO: 9357 - DNA, 331 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcctcgtctcctcctccctctaccacctctccacagcctacttccctctcctccctggcccctctactgggcctgccaaggctgcgtcctaacgggcctctgggtcatcgcccacgaatgcggccaccacgccttcagcgactac

SEQ ID NO: 9358 - DNA, 344 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctggcctctctactgggcctgccaagggtgcgtcctaaccggcgtctgggtcatagcccacgagtgcggccaccacgccttcagcgactac

SEQ ID NO: 9359 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccccccctctctactgggcctgccaagggtgcgtcctaacgggcctctgggtcatagcccacgagtgcggccaccacgccttcagcgactac

SEQ ID NO: 9360 - DNA, 347 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctcctctctactgggcctgccaagggtgcgtcctaaccggcgtctgggtcatagcccacgagtgcggccaccacgccttcagcgactac

SEQ ID NO: 9361 - DNA, 348 bp, Artificial
  Mutation in BnaC.FAD2.a introduced by TALE nuclease pair BnFAD2_T01
caggatccatgggtgcaggtggaagaatgcaagtgtctcctccctcaaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccgtctcctccctcgccctctccccgccgtggcctctctactgggccggccaagagtgcggcctgacgggcctctgggtcatcgcccacgaatgcggccaccacgccttcagcgactac

SEQ ID NO: 9362 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacactcgatccctcgctctttctcctacctcatctgggacatcatcatagcctcctgcttctactacgtcgccaccacttacttccctctcctccctcaccctctctccggcctctctactgggcctgccaagggtgcgtcctaaccggcgtctgggtcatagcccacgagtgcggccaccacgccttcagcgactac

SEQ ID NO: 9363 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaacgggcctctgggtcatagcccacgagtgcggccaccacgccttcagcgactac

SEQ ID NO: 9364 - DNA, 378 bp, Artificial
  Mutation in BnaC.FAD2.a introduced by TALE nuclease pair BnFAD2_T01
caggatccatgggtgcaggtggaagaatgcaagtctctcctccctccaagaagcctgaaaccgacaccatcaagcgcgtaccctgcgagacaccgcccttcactgtcggagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctctttgatccggttcctgaacaggatctatttgatggcctctctactgggcctgccaagggtgcgtcctaacgggcctctgggtcatcgcccacgaatgcggccaccacgccttcagcgactac

SEQ ID NO: 9365 - DNA, 318 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccaagggtgcgtcctaaccggcgtctgggtcatagcccacgagtgcggccaccacgccttcagcgactac

SEQ ID NO: 9366 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcatcctctctcctaactctctactgggcctgccaagggtgcgtcctaaccggcgtctgggtcatagcccacgagtgcggccaccacgccttcagcgactac

SEQ ID NO: 9367 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 9368 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgtggccaccacgccttcagcgactac

SEQ ID NO: 9369 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctggcacatcatcatagcctcctgcttctactacgtcgccaccacttacttccctctcctccctcaccctctctccgactggcctctctactgggcctgccaagggtgcgtcctaaccggcgtctgggtcatagcccacgagtgcggccaccacgccttcagcgactac

SEQ ID NO: 9370 - DNA, 335 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctactgggcctgccaagggtgcgtcctaaccggcgtctgggtcatagcccacgagtgcggccaccacgccttcagcgactac

SEQ ID NO: 9371 - DNA, 378 bp, Artificial
  Mutation in BnaC.FAD2.a introduced by TALE nuclease pair BnFAD2_T01
caggatccatgggtgcaggtggaagaatgcaagtgtctcctcactccaagaagactgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacggcgccaccacttacttccctctcctccctcaccctctctcctctttgatccggttcctgaacaggatctagttgacggcctctctactgggcctgccaagggtgcgtcctaaccggcgtctgggtcatagcccaccagtgcggccaccacgcctgcagcgactac

SEQ ID NO: 9372 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctaactctctactgggcctgccaagggtgcgtcctaacgggcctctgggtcatagcccacgagtgcggccaccacgccttcagcgactac

SEQ ID NO: 9373 - DNA, 334 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccacccttcactctcggagacctcaggaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccacgagtgcggccaccacgccttcagcgactac

SEQ ID NO: 9374 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcagcctctctactgggcctgccaagggtgcgtgctagccggcgtctgggtcatagcccacgagggcggccagcacgccttgagcgactag

SEQ ID NO: 9375 - DNA, 335 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttagcctgccaagggtgcgtcctaaccggcgtctgggtcatagcccacgagtgcggccaccacgccttcagcgactac

SEQ ID NO: 9376 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcggcctaaccggcgtctgggtcatagcccacgagtgcggccaccacgccttcagcgactac

SEQ ID NO: 9377 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaacgggcctctgggtcatcgcccacgaatgcggccaccacgccttcagcgactac

SEQ ID NO: 9378 - DNA, 350 bp, Artificial
  Mutation in BnaC.FAD2.a introduced by TALE nuclease pair BnFAD2_T01
caggatccatgggtgcaggtggcagaatgcaagtctcacctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctacagggcctgccaagggtgcggcctaaccggcgtctgggtcatagcccacgagtgcggccaccacgccttcagcgactac

SEQ ID NO: 9379 - DNA, 335 bp, Artificial
  Mutation in BnaC.FAD2.a introduced by TALE nuclease pair BnFAD2_T01
caggatccatgggtgcaggtgtaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgtcctaaccggcgtctgggtcatagcccacgagtgcggccaccacgccttcagcgactac

SEQ ID NO: 9380 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctctggcctctctactgggcctgccaagggtgcgtcctaacgggcctctgggtcatagcccacgagtgcggccaccacgccttcagcgactac

SEQ ID NO: 9381 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 9382 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctcttcgacatcatcatctcctcctgcttctactacgtcgccaccacttacttccctctcctccctcaccctctctcctctctctactgggcctgccaagggtgcgtcctaaccggcgtctgggtcatagcccacgagtgcggccaccacgccttcagcgactac

SEQ ID NO: 9383 - DNA, 347 bp, Artificial
  Mutation in BnaC.FAD2.a introduced by TALE nuclease pair BnFAD2_T01
caggatccatgggtgcaggtggaagaatgcaagtgtctcccccctccaagaagtctgaaaccgacaccatcaaccgcgtaccctgcgagacaccgcccttcactgtcggagaactcaagaaagcaatcccaccgcactgtttcaaacgctcgatccctcgctctttctcctacctcatctgggacatcatcatcgcctcctgcttctactacgtcgccaccacttacttccctctcctccctcaccctctctcctacttgcctctctactgggcctgtcaagagtgcgacctaaccggcgtctgggtcatcgcccacgaatgcggccaccacgccttcagcgactac

SEQ ID NO: 9384 - DNA, 348 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctggcctctctactgggcctgccaagggtgcgtcctaaccggcgtctgggtcatagcccacgagtgcggccaccacgccttcagcgactac

SEQ ID NO: 9385 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagactgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactcggcctgccaagggtgcgtcctaaccggcgtctgggtcatagcccacgagtgcggccaccacgccttcagcgactac

SEQ ID NO: 9386 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctggaaccgacaccatcaagcgcgtaccctgcgagacaccgcccttcactgtcggagaactcaagaaagcaatcccaccacactgtttcaaacgctcgatccctcgctcttcctcctacctcatctgggacatcatcatagcctcctgcttctactacgtcgccaccacttacttccctctcctccctcaccctctctcctacctggcctctctactgggcctgccaagggtgcgtcctaaccggcgtctgggtcatagcccacgagtgcggccaccacgccttcagcgactac

SEQ ID NO: 9387 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctctctactgggcctgccaagggtgcgtcctaaccggcgtctgggtcatagcccacgagtgcggccaccacgccttcagcgactac

SEQ ID NO: 9388 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcacctacggcgccggcctctctactgggcctgccaagggtgcgtcctaaccggcgtctgggtcatagcccacgagtgcggccaccacgcctgcagcgactac

SEQ ID NO: 9389 - DNA, 356 bp, Artificial
  Mutation in BnaC.FAD2.a introduced by TALE nuclease pair BnFAD2_T01
caggatccatgggtgcaggtggaagaatgcaagtctcacctccctccagctcccccggaaccaacaccctaaaacgcgtcccctgcgagacaccaccattcactctcggagacctaaagaaagaaatcccacctcactgcttcaaacgctccatccctagctctttctcctacctcatctgggacatcatcatagcctcctgcttctactacgtcgccaccacttacttgcctctcctccctcaccctctctcctacttcgacgccttgcctctctactgggcctgccaagggcgcgtcctaaccggcgtcttggtcatagcccacgagtgcgcccaccacgccttcagcgactac

SEQ ID NO: 9390 - DNA, 347 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgtggccaccacgccttcagcgactac

SEQ ID NO: 9391 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 9392 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccccttacttccctctcctccctcaccctctctcctccttcgcccctggcctctctactgggcctgccaagggtgcgtcctaaccggcgtctgggtcatagcccacgagtgcggccaccacgccttcagctactac

SEQ ID NO: 9393 - DNA, 351 bp, Artificial
  Mutation in BnaC.FAD2.a introduced by TALE nuclease pair BnFAD2_T01
caggatccatgggtgcaggtggaagaatgcaagtctctcctcactccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccaagggtgcgtcctaaccggcgtctgggtcatagcccacgagtgcggccaccacgccttcagcgactac

SEQ ID NO: 9394 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtctccaccacttacttccctctcctccctcaccctctctcctacgtctggcccctctactgggcctgccaagggtgcgtcctaaccggcgtctgggtcatagcccacgagtgcggccaccacgccttcagcgactac

SEQ ID NO: 9395 - DNA, 383 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcagcggctgttgccggtgctgtgccaggcccacggcttctctctactgcgcctgccaagagtgcgtcctaaccggcgtctgggtcatagcccacgagtgcggccgccacgccttcagcgactac

SEQ ID NO: 9396 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaagggtgcgtcctaacgggcctctgggtcatcgcccacgagtgcggccaccacgccttcagcgactac

SEQ ID NO: 9397 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcctctctactgggcctgccaagggtgcgtcctaaccggcgtctgggtcatagcccactagtgcggccaccacgccttcagcgactac

SEQ ID NO: 9398 - DNA, 343 bp, Artificial
  Mutation in BnaC.FAD2.a introduced by TALE nuclease pair BnFAD2_T01
caggatccatgggtgcaggtgcaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacctctctactgggcctgccaagggtgcgtcctaaccggcgtctgggtcatagcccacgagtgcggccaccacgccttcagcgactac

SEQ ID NO: 9399 - DNA, 347 bp, Artificial
  Mutation in BnaC.FAD2.a introduced by TALE nuclease pair BnFAD2_T01
caggatccatgggtgcaggtggaagaatgcaagtgtgtcctccctccaagaagtctgaaaccgacaccatcaagcgcgtaccctgcgagacaccgcccttcactgtcgcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacaggcctctctactgggcctgccaagggtgcgtcctaaccggcgtctgggtcatagcccacgagtgcggccaccacgccttcagccactac

SEQ ID NO: 9400 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgcctagggtgcgtcctaaccggcgtctgggtcatagcccacgagtgcggccaccacgccttcagcgactac

SEQ ID NO: 9401 - DNA, 323 bp, Artificial
  Mutation in BnaC.FAD2.a introduced by TALE nuclease pair BnFAD2_T01
caggatccatgggggcagggggaagaatgcaagtgtctcctccctcccagaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagggtgcgtcctaaccggcgtctgggtcatagcccacgaatgtggccaccacgccttcagcgactac

SEQ ID NO: 9402 - DNA, 348 bp, Artificial
  Mutation in BnaC.FAD2.a introduced by TALE nuclease pair BnFAD2_T01
caggattcatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactccgtcgccaccacttacttccctctcctccctcaccctctctcccacttggcctctctactgggcctgccaagggtgcgtcctaaccggcgtctgggtcatagcccacgagtgcggccaccacgccttcagcgactac

SEQ ID NO: 9403 - DNA, 350 bp, Artificial
  Mutation in BnaC.FAD2.a introduced by TALE nuclease pair BnFAD2_T01
caggatccatgggtgcaggtggaagaatgtaagtgtctcctccctccaagaagactgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 9404 - DNA, 346 bp, Artificial
  Mutation in BnaC.FAD2.a introduced by TALE nuclease pair BnFAD2_T01
caggatccatgggtgcaggtggaagaatgcaagtgtcacctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcctctctactgggcctgcctagggtgcgtcctaaccggcgtctgggtcatagcccgcgagtgctgcctccacgccatcagcgactac

SEQ ID NO: 9405 - DNA, 389 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccacccacgtataaaccgtcgatgccctgctgaatattgaactgaaccaggcgactggcctctctactgggcctgccaagggtgcgtcctaaccggcgtctgggtcatagcccacgagtgcggccaccacgccttcagcgactac

SEQ ID NO: 9406 - DNA, 395 bp, Artificial
  Mutation in BnaC.FAD2.a introduced by TALE nuclease pair BnFAD2_T01
caggatccatgggtgcaggtggaagaatgcaagtgtctcctccttccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccgcaacctcttcctggctagcggtacgcttattaattgcgccctggcctctctactgggcctgccaagggtgcgtgctagcggtcctcggggtcatcgcccaccaatgcggccaccacgccttcgtcgactac

SEQ ID NO: 9407 - DNA, 348 bp, Artificial
  Mutation in BnaC.FAD2.a introduced by TALE nuclease pair BnFAD2_T01
caggatcatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 9408 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttccgggcctctctactgggcctgccaagggtgcgtcctaaccggcgtctgggtcatagcccacgagtgcggccaccacgccttcagcgactac

SEQ ID NO: 9409 - DNA, 344 bp, Artificial
  Mutation in BnaC.FAD2.a introduced by TALE nuclease pair BnFAD2_T01
caggatccatgggtgcagggggaagaatgcaagtgtctcccccctccaagaagtctgaaaacgacaccatcaagcgcgtaccctgcgagacaccgcccttctctgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaagggtgcgtcctaaccggcgtctgggtcatagcccacgagtgcggccaccacgccttcagcgactac

SEQ ID NO: 9410 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaacgggcctctgggtcatcgcccacgaatgcggccaccacgccttcagcgactac

SEQ ID NO: 9411 - DNA, 355 bp, Artificial
  Mutation in BnaC.FAD2.a introduced by TALE nuclease pair BnFAD2_T01
caggatccatgggtgcaggtggaagaatgcaagtgtctcctccaaacaaaaagactgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttcgccgttggcctctctactgggcctgccaagggtgcgtcctaaccggcgtctggttcatagcccaccagtgctgcctccacgccatcagcgactac

SEQ ID NO: 9412 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatccagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccttcgcctctctactgggcctgcccagcgtgcgtcctaaccggcgtgtgggtcatagcccacgagtgcggccaccacgccatcagcaactac

SEQ ID NO: 9413 - DNA, 404 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcttgccgccatcgtggctggcgatggccaccacctgctccggggtcaagccgtgggcctctctactgggcctgccaagggtgcgtcctaacgggcctctgggtcatcgcccacgaatgcggccaccacgccttcagcgactac

SEQ ID NO: 9414 - DNA, 343 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaaccggcgtctgggtcatagcccacgagtgcggccaccacgccttcggcgactac

SEQ ID NO: 9415 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaccgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggcgtgtcctaaccggcgtctgggtcatagcccacgagtgcggccaccacgccttctgcgactac

SEQ ID NO: 9416 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctggcctctctactgggcctgccaagggtgcgtcctaaccggcgtctgggtcatagcccacgagtgcggccaccacgccttcagcgactac

SEQ ID NO: 9417 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaacgggcctctgggtcatagcccacgagtgcggccaccacgccttcagcgactac

SEQ ID NO: 9418 - DNA, 398 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgccaacttctcaagattgcaaaacgtggcggcgtgaccgcagtggaggcagtgcatgcgcctctctactgggcctgccaagcgtgcgtcctaaccggcgtcggggtcatagcccgcgagtgcggccaccacgccatcagcgactac

SEQ ID NO: 9419 - DNA, 350 bp, Artificial
  Mutation in BnaC.FAD2.a introduced by TALE nuclease pair BnFAD2_T01
caggatccatgtgtgcaggtgcaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggccagccaagggtgcttcttagccggcgtctgggtcatagcgcgccagtgcggccaccacgccttcagcgactac

SEQ ID NO: 9420 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgccgcctggcccctctactgggcctgccaaggctgcgtcctaacgggcctctgggtcatagcccacgagtgcggccaccacgccttcagcgactac

SEQ ID NO: 9421 - DNA, 347 bp, Artificial
  Mutation in BnaC.FAD2.a introduced by TALE nuclease pair BnFAD2_T01
caggatccatgggtgcaggcggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgcgcctgccaagggtgcgtcctaaccggcgtctgggtcatagcccacgagtgcggccaccacgccttcagcgactac

SEQ ID NO: 9422 - DNA, 344 bp, Artificial
  Mutation in BnaC.FAD2.a introduced by TALE nuclease pair BnFAD2_T01
caggatccatgggtgcaggtggaagaatgcaagtctctcctccatccagctccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgccttcagcgactac

SEQ ID NO: 9423 - DNA, 350 bp, Artificial
  Mutation in BnaC.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactactagcctctctactgggcctgccaagggtgcgtcctaaccggcgtctgggtcatagcccacgagtgcggccaccacgccatcagcgactac

SEQ ID NO: 9424 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttgcctctctactgggcctgccaagggtgcgtcctaacgggcctctgggtcatagcccacgagtgcggccaccacgccttcagcgactac

SEQ ID NO: 9425 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgggcctctctactgggcctgccaagggtgcgtcctaacgggcctctgggtcatagcccacgagtgcggccaccacgccttcagcgactac

SEQ ID NO: 9426 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatatgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 9427 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggccttccaaggctgcgtcctaacgggcctctgggtcatcgcccacgaatgcggccaccacgccttcagcgactac

SEQ ID NO: 9428 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgtcaagtgtgcgtcctaaccggcgtctgggtcatagcccacgagtgcggcgaccacgccttcagcgactac

SEQ ID NO: 9429 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgggcctctctactgggcctgccaagggtgcgtcctaaccggcgtctgggtcatagcccacgggtgcggccaccacgccttcagcgactac

SEQ ID NO: 9430 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagtgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtcggggtcatagcccacgagtgcggccaccacgccttcagcgactac

SEQ ID NO: 9431 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 9432 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgactggcctctctactgggcctgccaagggtgcgtcctaaccggcgtctgggtcatagcccacgagtgcggccaccacgccttcagcgactac

SEQ ID NO: 9433 - DNA, 346 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgcgcctgccaagggtgcgtcctaaccggcgtctgggtcatagcccacgagtgcggccaccacgccttcagcgactac

SEQ ID NO: 9434 - DNA, 349 bp, Artificial
  Mutation in BnaC.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacccccgcctctctactgggcctgccaagggtgcgtccgaaccgccctctggctcatcgcccccgtatgctatcaccacgcccgcagccactac

SEQ ID NO: 9435 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccatcagcgactac

SEQ ID NO: 9436 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctcctcgcctctctactgggcctgccaaggctgcttcctaaccgacgtctgggtcattgcccgcgagtgcggccaccgcgccttcaacgactac

SEQ ID NO: 9437 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgactggcctctctactgggcctgccaaggctgcgtcctaacgggcgtctgggtcatagcccacgagtgcggccaccacgccttcagcgactac

SEQ ID NO: 9438 - DNA, 349 bp, Artificial
  Mutation in BnaC.FAD2.a introduced by TALE nuclease pair BnFAD2_T01
caggatccatgggtgcaggtggaagaatgcaagtctctcctccatccagctccaccggaaccaacaccatcaagcgcgtaccctgcgagacaccgcccttcactgtcggagaactcaagaaagcaatcccaccgcactgtttcaaacgctcgatccctcgctctttctcctacctcatctgggacatcatcatagcctactgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 9439 - DNA, 348 bp, Artificial
  Mutation in BnaC.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacatggcctctctactcggcctgccaagggtgcgtcctaaccggcgtctgggtcatagcccacgagtgcggccaccacgccttcagcgactac

SEQ ID NO: 9440 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacctctctactgggcctgccaagggtgcgtcctaaccggcgtctgggtcatagcccacgagtgcggccaccacgccttcagcgactac

SEQ ID NO: 9441 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagactgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgcgcctgccaagggtgcgtcctaaccggcgtctgggtcatagcccacgagtgcggccaccacgccttcagcgactac

SEQ ID NO: 9442 - DNA, 338 bp, Artificial
  Mutation in BnaC.FAD2.a introduced by TALE nuclease pair BnFAD2_T01
caggatccatgggtgcaggtcgaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcctgccaagggtgcgtcctaaccggcgtctgggtcatagcccacgagttcggccaccacgccttcagcgactac

SEQ ID NO: 9443 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatccctccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatcgcccacgaatgcggccaccacgccttcagcgactac

SEQ ID NO: 9444 - DNA, 349 bp, Artificial
  Mutation in BnaC.FAD2.a introduced by TALE nuclease pair BnFAD2_T01
caggatccatgggtgcaggtgggagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 9445 - DNA, 345 bp, Artificial
  Mutation in BnaC.FAD2.a introduced by TALE nuclease pair BnFAD2_T01
caggatccatgggtgcaggtggaagaatgcaagtgactcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 9446 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaagggtgcgtcctaacgggcctctgggtcatagcccacgagtgcggccaccacgccttcagcgactac

SEQ ID NO: 9447 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactcggcctgccaagggtgcgtcctaaccggcgtctgggtcatagcccacgagtgcggccaccacgccttcagcgactac

SEQ ID NO: 9448 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaagggtgcgtcctaaccggcgtctgggtcatagcccacgagtgcggccaccacgccatcagcgactac

SEQ ID NO: 9449 - DNA, 342 bp, Artificial
  Mutation in BnaC.FAD2.a introduced by TALE nuclease pair BnFAD2_T01
caaggatccatgggtgcaggtggaagaatgcaagtgtctcctccctcaaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccaaggctgcgtcctaacgggcctctgggtcatagcccacgagttcggccgccacgccttcggcgactac

SEQ ID NO: 9450 - DNA, 378 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgcctccagcgcctgcttgccgccatcgtggctggcgatggccaccacctgctccggggtcaagccgggagggctgggtcatagcccacgagtgcggccaccacgccttcagcgactac

SEQ ID NO: 9451 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggtgaccacgccttcagcgactac

SEQ ID NO: 9452 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacctctctactgggcctgccaaggctgcgtcctaacgggcctctgggtcatcgcccacgaatgcggcctccacgccttcatcgactac

SEQ ID NO: 9453 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgatacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 9454 - DNA, 277 bp, Artificial
  Mutation in BnaC.FAD2.a introduced by TALE nuclease pair BnFAD2_T01
caggatccatgggtgcaggtggaagaatgcaagtgcctcccccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacgccatcagcgactac

SEQ ID NO: 9455 - DNA, 344 bp, Artificial
  Mutation in BnaC.FAD2.a introduced by TALE nuclease pair BnFAD2_T01
caggatccatgggtgcaggtggaagaatgcaagtgtctcctccctcccagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaagggtgcgtcctaaccggcgtctgggtcatagcccacgagtgcggccaccacgccttcagcgactac

SEQ ID NO: 9456 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcgagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 9457 - DNA, 318 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggtctgccaagggtgcgtcctaaccggcgtctgggtcatagcccacgagtgcggccaccacgccttcagcgactac

SEQ ID NO: 9458 - DNA, 312 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 9459 - DNA, 349 bp, Artificial
  Mutation in BnaC.FAD2.a introduced by TALE nuclease pair BnFAD2_T01
caggatccatgggtgcaggtggaagaatgcaagtgtcacctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 9460 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctcctttggcctctctactgggcctgccaagggtgcgtcctaacgggcctctgggtcatagcccacgagtgcggccaccacgccttcagcgactac

SEQ ID NO: 9461 - DNA, 348 bp, Artificial
  Mutation in BnaC.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctggtacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 9462 - DNA, 337 bp, Artificial
  Mutation in BnaC.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctactgggcctgccaagggtgcgtcctaaccggcgtctgggtcatagcccacgagtgcggccaccacgccttcagcgactac

SEQ ID NO: 9463 - DNA, 324 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcgccaagggtgcgtcctaaccggcgtctgggtcatagcccacgagtgcggccaccacgccttcagcgactac

SEQ ID NO: 9464 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccatcagcgactac

SEQ ID NO: 9465 - DNA, 357 bp, Artificial
  Mutation in BnaC.FAD2.a introduced by TALE nuclease pair BnFAD2_T01
caggatccatgggtgcaggtgcaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcgcctggcctctctactgggcctgccaagggtgcgtcctaaccggcgtctgggtcatagcccacgagtgcggccaccacgccttcagcgactac

SEQ ID NO: 9466 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccatcaaacgcgtcccctgcgagacaccacccttcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcgtccaccacgccttcagcgactac

SEQ ID NO: 9467 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagactgaacccgacaccatcaagcgcgtaccctgcgagacaccgcccttcactgtcggagaactcaagaaagcaatcccaccgcactgtttcaaacgctcgatccctcgctctttctcatacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgccatcagcgactac

SEQ ID NO: 9468 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcaccaccacttacttccctctcctccctcaccctctctcctacttcgccctggcctctctactgggcctgccaagggtgcgtcctaacgggcctctgggtcatcgcccacgaatgcggccaccacgccttcagcgactac

SEQ ID NO: 9469 - DNA, 347 bp, Artificial
  Mutation in BnaC.FAD2.a introduced by TALE nuclease pair BnFAD2_T01
caggatccatgggtgcaggtggaagaatgcaagtgtctcctccctcccagaagcctgaaaccgacaccatcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 9470 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatctctactgggcctgccaagggtgcgtcctaaccggcgtctggggcatagcccacgagtgcggccaccacgccttcagcgactac

SEQ ID NO: 9471 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcacacgagtgcggccaccacgccttcagcgactac

SEQ ID NO: 9472 - DNA, 345 bp, Artificial
  Mutation in BnaC.FAD2.a introduced by TALE nuclease pair BnFAD2_T01
caggatccatgggtgcaggtggaagaatgcaagtctctcctccctccaagaagactgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 9473 - DNA, 350 bp, Artificial
  Mutation in BnaC.FAD2.a introduced by TALE nuclease pair BnFAD2_T01
caggatccatgggtgcaggtggaagaatgcaagtctctcctccttccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 9474 - DNA, 355 bp, Artificial
  Mutation in BnaC.FAD2.a introduced by TALE nuclease pair BnFAD2_T01
caggatccatgggtgcaggtggaagaatgcaagtgtctcctccctcccagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcgcctggcctctctactgggcctgccaagggtgcgtcctaaccggcttcgaggtcatagcccacgagtgctgccaccacgccttcatcgactac

SEQ ID NO: 9475 - DNA, 387 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccccggagcaggtggtggccatcgccagccacgatggcgcctggcctctctactgggcctgccaagggtgcgtcctaaccggcgtctgggtcatagcccacgagtgcggccaccacgccttcagcgactac

SEQ ID NO: 9476 - DNA, 347 bp, Artificial
  Mutation in BnaC.FAD2.a introduced by TALE nuclease pair BnFAD2_T01
caggatcatgggtgcaggtgggagaatgtaagtgttttctccctccaagaaggctgaaaccgacaccatcaagcgcctaccctgagagacaccgcccttcactgtcggagaactcaagaaagcaatcccaccgcactgtttcaaacgctcgatccctcgctctttctcctacctcatctgggacatcatcatagcctcctgcttccactacgtccccaccacttacttccctctcctccccccccccctctcccgcatggcctctctactgggcctgccaaggctgcgtcctaacgggcctctgggtcatagcccacgagtgcggccaccacgccttcagcgactac

SEQ ID NO: 9477 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaagggtgcgtcctaaccggcgtctgggtcatagcccacgagtgcggccacctcgccttcatcgactac

SEQ ID NO: 9478 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccgtcgcccctggcctctctactgggcctgccaagggtgcgtcctaaccggcgtctgggtcatagcccacgagtgcggccaccacgccttcagcgactac

SEQ ID NO: 9479 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgcctcagcgactac

SEQ ID NO: 9480 - DNA, 300 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccaagggtgcgtcctaaccggcgtctgggtcatagcccacgaatgcggccaccacgccttcagcgactac

SEQ ID NO: 9481 - DNA, 347 bp, Artificial
  Mutation in BnaC.FAD2.a introduced by TALE nuclease pair BnFAD2_T01
caggatccatgggtgcaggtagaagaatgcaagtgtctcctccctccgagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgactggcctctctactgggcctgccaagggtgcgtcctaaccggcgtctgggtcatagcccacgagtgcggccaccacgccttcagcgactac

SEQ ID NO: 9482 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggccggccaagggtgcgtcctaacgggcctctgggtcatagcccacgagtgcggccaccacgccttcagcgactac

SEQ ID NO: 9483 - DNA, 350 bp, Artificial
  Mutation in BnaC.FAD2.a introduced by TALE nuclease pair BnFAD2_T01
caggatccatgggtgcaggtggaagaatgcaagtgtctcctccatccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 9484 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctatttctcctacctcatctgggacatcatcatagcctcctgcttctactacgtcgccaccacttacttccctctcctccctcaccctctctcctaggcctctctactgggcctgccaagggtgcgtcctaacgggcctctgggtcatcgcccacgaatgcggccaccacgccttcagcgactac

SEQ ID NO: 9485 - DNA, 348 bp, Artificial
  Mutation in BnaC.FAD2.a introduced by TALE nuclease pair BnFAD2_T01
caggatccatgggtgcaggtggaagaatgcaagtgtctcctccctacaagaagcctgaaaccgacaccatcaagcgcgtaccctgcgagacaccgcccttcactgtcggagaactcaagaaagcaatcccaccgcactgtttcaaacgctcgatccctcgctctttctcatacctcatctgggacatcatcatagcctcctgcttctactacgtcgccaccacttacttccctctcctccctcaccctctctcccacttggcctctctactgggcctgccaagggtgcgtcctagccggcgtctgggtcatagcccacgagtgcggccaccacgccttcagcgactac

SEQ ID NO: 9486 - DNA, 323 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagggtgcgtcctagccggcgtctgggtcatagcccacgagtgcggccaccacgccttcagcgactac

SEQ ID NO: 9487 - DNA, 342 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgtctctctactgggcctgccaagggtgcgtcctaaccggcgtctgggtcatagcccacgagtgcggccaccacgccttcagcgactac

SEQ ID NO: 9488 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttcctctctactgggcctgccaagggtgcgtccgaaccggcgtctgggtcatagcccacgagtgcggccaccacgccatcagcgactac

SEQ ID NO: 9489 - DNA, 318 bp, Artificial
  Mutation in BnaC.FAD2.a introduced by TALE nuclease pair BnFAD2_T01
caggatccatgggtgcaggtggaagaatgcaagtgtatcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccaagggtgcgtcctaaccggcgtctgggtcatagcccacgagtgcggccaccacgccttcagcgactac

SEQ ID NO: 9490 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 9491 - DNA, 339 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctctctactgggcctgccaagggtgcgtcctaaccggcgtctgggtcatagcccacgagtgcggccaccacgccttcagcgactac

SEQ ID NO: 9492 - DNA, 348 bp, Artificial
  Mutation in BnaC.FAD2.a introduced by TALE nuclease pair BnFAD2_T01
caggatccatgggtgcaggtggaagaatgcaagtgtctcccccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 9493 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaaggctgcgtcctaacgggcctctgggtcatcgcccacgaatgcggccaccacgccttcagcgactac

SEQ ID NO: 9494 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttggcctctctactgggcctgccaagggtgcgtcctaaccggcgtctgggtcatagcccacgagtgcggccaccacgccttcagcgactac

SEQ ID NO: 9495 - DNA, 348 bp, Artificial
  Mutation in BnaC.FAD2.a introduced by TALE nuclease pair BnFAD2_T01
caggatccataggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttgcctctctactgggcctgccaagggtgcgtcctaaccggcgtctgggtcatagcccacgagtgcggccaccacgccttcagcgactac

SEQ ID NO: 9496 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 9497 - DNA, 337 bp, Artificial
  Mutation in BnaC.FAD2.a introduced by TALE nuclease pair BnFAD2_T01
caggatccatgggtgcaggtggaagaatgcaagtgtctcatccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacactgggcctgccaaggctgcgtcctaaccggcgtctgggtcatagcccacgagtgcggccaccacgccatcagcgactac

SEQ ID NO: 9498 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgcccgcctggcctctctactgggcctgccaagggtgcgtcctaaccggcgtctgggtcatagcccacgagtgcggccaccacgccttcagcgactac

SEQ ID NO: 9499 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtccccaccccttacttccctctcctccctcaccctctctcctcccgcctggcctctctactgggcctgccaagggtgcgtcctaaccggcgtctgggtcatcgcccacgagtgcggccaccacgccttcagctactac

SEQ ID NO: 9500 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgaatgcggccaccacgccttcagcgactac

SEQ ID NO: 9501 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacgccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 9502 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctgcctctctactgggcctgccaagggtgcgtcctaaccggcgtctgggtcatagcccacgagtgcggccaccacgccttcagcgactac

SEQ ID NO: 9503 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccatcagcgactac

SEQ ID NO: 9504 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 9505 - DNA, 390 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttcactctcctccctcaccctctctcctacttgctggcgatggccaccacctgctggggggtcaagccgcgggcggcctctctactgggcctgccaagggtgcgtcctaaccggcgtctgggtcatagcccacgagtgcggccaccacgccttcagcgactac

SEQ ID NO: 9506 - DNA, 337 bp, Artificial
  Mutation in BnaC.FAD2.a introduced by TALE nuclease pair BnFAD2_T01
caggatccatgggtgcaggtggaagaatgcaagtgtctcctcccttcaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctactgggcctgccaagggtgcgtcctaaccggcgtctgggtcatagcccacgagtgctgccaccacgccttcagcgactac

SEQ ID NO: 9507 - DNA, 351 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctcgcctggcctctctactgggcctgccaagggtgcgtcctaaccggcgtctgggtcatagcccacgagtgcggccaccacgccttcagcgactac

SEQ ID NO: 9508 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaaggctgcgtcctaacgggcctctgggtcatagcccacgagtgcggccaccacgccttcagcgactac

SEQ ID NO: 9509 - DNA, 355 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcctggcctctctactgggcctgccaagggtgcgtcctaacgggcgtctgggtcagagcccacgagtgcggccaccacgccttcagcgactac

SEQ ID NO: 9510 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctctactgggcctgccaagggtgcgtcctaaccggcgtctggggcatagcccacgagtgcggccaccacgccatcagcgactac

SEQ ID NO: 9511 - DNA, 424 bp, Artificial
  Mutation in BnaC.FAD2.a introduced by TALE nuclease pair BnFAD2_T01
caggatccatgggtgcaggcggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctccagcgcctgcttgccgccatcgtggctggcgatggccaccacctgctccggggtcaagccgtgggcctggcatggcctctctactgggcctgccaagggtgcgtcctaaccggcgtctgggtcatagcccacgagtgcggccaccacgccttcagcgactac

SEQ ID NO: 9512 - DNA, 344 bp, Artificial
  Mutation in BnaC.FAD2.a introduced by TALE nuclease pair BnFAD2_T01
caggatccatgggtgcaggtagaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgcgcctgccatggctgcgtcctaaccggcgtctgggtcatagcccacgagtgcggccaccacgccttcagcgactac

SEQ ID NO: 9513 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctccggcctctctactgggcctgccaagggtgcgtcctaaccggcgtctgggtcatagcccacgagtgcggccaccacgccttcagcgactac

SEQ ID NO: 9514 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaacgggcctctgggtcatcgcccacgaatgcggccaccacgccatcagcgactac

SEQ ID NO: 9515 - DNA, 347 bp, Artificial
  Mutation in BnaC.FAD2.a introduced by TALE nuclease pair BnFAD2_T01
caggatccatgggtgcagggagaagaatgcaagtgtctcctccttcccagaagtctgaaaccgacaccatcaagcgcgtaccctgcgagacaccgcccttcactgtcggagaactcaagaaagcaatcccaccgcactgtttcaaacgctcgatccctctctctttctcctacctcatctgggacatcatcatagcctcctgcttctactacgccgccaccacttacttccctctcctccctcaccctctcgccgactggcctctctactgggccggccaaggctgcatcctaacgggcctctgggtcagagcccacgagtgcggccaccacgccttcatcgactac

SEQ ID NO: 9516 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctagccggcgtctgggtcatagcccacgagtgcggccaccacgccttcagcgactac

SEQ ID NO: 9517 - DNA, 343 bp, Artificial
  Mutation in BnaC.FAD2.a introduced by TALE nuclease pair BnFAD2_T01
caggatccatgggtgcaggtggaagaatgcaagtttctcctccctccaagaagtctgaaaccgacaccatcaagcgcgtaccctgcgagacaccgcccttcactgtcggagaactcaagcaagcaatcccaccgcactgtttcaaacgctcgatccctcgctccttctcctacctcatctgggacatcatcatagcctcctgcttctactacgtcgccaccacttacttccctctcctccctcaccctctcccctaactctctactgggcctgccaaggttgcgtcctaaccggcgtctgggtcatagcccacgagtgcggccaccacgccttcagcgactac

SEQ ID NO: 9518 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgtgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 9519 - DNA, 260 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcccttaccacgccttcatcgactac

SEQ ID NO: 9520 - DNA, 348 bp, Artificial
  Mutation in BnaC.FAD2.a introduced by TALE nuclease pair BnFAD2_T01
caggatccatgggtgcaggtggaagaatgcaagtctctcccccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggtcaccacgccatcagcgactac

SEQ ID NO: 9521 - DNA, 345 bp, Artificial
  Mutation in BnaC.FAD2.a introduced by TALE nuclease pair BnFAD2_T01
caggatccatgggtgcaggtgcaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 9522 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagactgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagcgtgcgtcctaaccggcgtctgggtcatagcccacgtgtgcggcgaccacgccatcagcgactac

SEQ ID NO: 9523 - DNA, 378 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctctttgagccggttcctgaacaggatctattggatggcctctctactgggcctgccaagggtgcgtcctaaccggcgtctgggtcatagcccacgagtgcggccaccacgccttcagcgactac

SEQ ID NO: 9524 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgccttcagcgactac

SEQ ID NO: 9525 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgagtgcggccaccacgccttcagcgactac

SEQ ID NO: 9526 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactggacctgccaagggtgcgtcctaaccggcgtctgggtcatagcccacgagtgcggccaccacgccttcagcgactac

SEQ ID NO: 9527 - DNA, 347 bp, Artificial
  Mutation in BnaC.FAD2.a introduced by TALE nuclease pair BnFAD2_T01
caggatccatgggtgcaggtggaagaatgcaagtgtctcccccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcgccctctctcctactggcctctctactgggcctgccaagggtgcgtcctaaccggcgtctgggtcatagcccacgagtgcggccaccacgccttcagcgactac

SEQ ID NO: 9528 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacacccccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccctaggcctctctactgggcctgccaagggtgcgtcctaaccggcgtctgggtcatagcccacgagtgcggccaccacgccttcagcgactac

SEQ ID NO: 9529 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaaccggcgtctggggcatagcccacgagtgcggccaccacgccttcagcgactac

SEQ ID NO: 9530 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaaggctgcgtcctaacgggcctctgggtcatagcccacgagtgcggccaccacgccatcagcgactac

SEQ ID NO: 9531 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttggcctctctactgggcctgccaagggtgcgtcctaaccggcgtctgggtcatagcccacgagtgcggccaccacgccttcagcgactac

SEQ ID NO: 9532 - DNA, 358 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctcgcctggcctctctactgggcctgccaagggtgcgtcctaaccggcgtcggggtcatagcccacgagtgcggccaccacgccttcagcgactac

SEQ ID NO: 9533 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctctggcccctctactgggcctgccaaggctgcgtcctaacgggcctctgggtcatcgcccacgaatgcggccaccacgccttcagcgactac

SEQ ID NO: 9534 - DNA, 349 bp, Artificial
  Mutation in BnaC.FAD2.a introduced by TALE nuclease pair BnFAD2_T01
caggatccatgggtgcaggcggaagaatgcaagtgtctcctccctccaagaagcctgaaaccgacaccatcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgggcctctctactgggcctgccaaggctgcgtcctaacgggcctctgggtcatcgcccacgaatgcggcgaccacgccttcagcgactac

SEQ ID NO: 9535 - DNA, 329 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccaagggtgcgtcctaaccggcgtctgggtcatagcccactagtgcggccaccacgccttcagcgactac

SEQ ID NO: 9536 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccgcgagtgcggccaccacgccttcagcgactac

SEQ ID NO: 9537 - DNA, 335 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctcctctctactgggcctgccaagggtgcgtcctaaccggcgtctgggtcatagcccacgagtgcggccaccacgccttcagcgactac

SEQ ID NO: 9538 - DNA, 343 bp, Artificial
  Mutation in BnaC.FAD2.a introduced by TALE nuclease pair BnFAD2_T01
caggatccatgggtgcaggtgcaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctggggcatagcccgcgagtgcggccaccacgccatcagcgactac

SEQ ID NO: 9539 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcagcctctctactgggcctgccaagggtgcgtcctaaccggcgtctgggtcatagcccacgagtgcggccaccacgccttcagcgactac

SEQ ID NO: 9540 - DNA, 345 bp, Artificial
  Mutation in BnaC.FAD2.a introduced by TALE nuclease pair BnFAD2_T01
caggatccatgggtgcaggtggaagaatgcaagtgtctcatacaaccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaaccggcgtctgggtcatagcccacgagtgcggccaccacgccttcagcgactac

SEQ ID NO: 9541 - DNA, 378 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctttgatccggttcctgaacaggatctatttgatggcctctctactgggcctgccaagggtgcgtcctaacgggcctctgggtcatcgcccacgaatgcggccaccacgccttcagcgactac

SEQ ID NO: 9542 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccgtcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacctctctactgggcctgccaagggtgcgtcctaacgggcgtctgggtcatagcccgcgagtgcggcctccacgccttcagcgactac

SEQ ID NO: 9543 - DNA, 387 bp, Artificial
  Mutation in BnaC.FAD2.a introduced by TALE nuclease pair BnFAD2_T01
caggatccatgggtgcaggtggaagaatgcaagtctatcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgccatcgtggctggcgatggtcaccacctgctccgggcctctctactgggcctgccaagggtgcgtcctaaccggcgtctgggtcatagcccacgagtgcggccaccacgccttcagcgactac

SEQ ID NO: 9544 - DNA, 390 bp, Artificial
  Mutation in BnaC.FAD2.a introduced by TALE nuclease pair BnFAD2_T01
caggatccatgggtgcaggtggaagaatgcaagtgtctcctccctccaagaagactgaaaccgacaccatcaagcgcgtaccctgcgagacaccgcccttcactgtcggagaactcaagaaagcaatcccaccgcactgtttcaaacgctagatccctcgctctttctcctacctcatctgggacatcatcatagcctcctgcttctactacgtcgccaccacttacttccctctcctccctcaccctctctcctacttgctggcgatggccaccacctgctggggggtcaagccgtgggcggcctctctactgggcctgccaagggtgcgtcctaaccggcgtctgggtcatagcccacgagtgcggccaccacgccttcagcgactac

SEQ ID NO: 9545 - DNA, 352 bp, Artificial
  Mutation in BnaC.FAD2.a introduced by TALE nuclease pair BnFAD2_T01
caggatccatgcgtgcaggtggaagaatgcaagtgaatccaccatccaagaagactgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgctggcctctctactgggcctgccaagggtgcgtcctaaccggcgtctgggtcatagcccacgagtgcggccaccacgccatcagcgactac

SEQ ID NO: 9546 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcatcctaaccggcgtctgggtcatagcccacgagtgcggccaccacgccttcagcgactac

SEQ ID NO: 9547 - DNA, 347 bp, Artificial
  Mutation in BnaC.FAD2.a introduced by TALE nuclease pair BnFAD2_T01
caggatccatgggtgcaggtggaagaatgcaagtgtctcctccatccaagaagcctgaaaccgacaccatccagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 9548 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 9549 - DNA, 349 bp, Artificial
  Mutation in BnaC.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccactagtgcggccaccacgccttcagcgactac

SEQ ID NO: 9550 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaacgggcctctgggtcatagcccacgagtgcggccaccacgccttcagcgactac

SEQ ID NO: 9551 - DNA, 386 bp, Artificial
  Mutation in BnaC.FAD2.a introduced by TALE nuclease pair BnFAD2_T01
caggatccatgggtgcaggtgcaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggccaccacctgctggggggtcaagccgtgggcctggcacagtctctactgggcctgccaagggtgcgtcctaaccggcgtctgggtcatagcccacgagtgcggccaccacgccttcagcgactac

SEQ ID NO: 9552 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 9553 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgcttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 9554 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccctggcctctctactgggcctgccaagggtgcgtcctaaccggcgtctgggtcatagcccacgagtgcggccaccacgccttcagcgactac

SEQ ID NO: 9555 - DNA, 347 bp, Artificial
  Mutation in BnaC.FAD2.a introduced by TALE nuclease pair BnFAD2_T01
caggatccatgggtgcaggtcgaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 9556 - DNA, 343 bp, Artificial
  Mutation in BnaC.FAD2.a introduced by TALE nuclease pair BnFAD2_T01
caggatccatgggtgcaggtggaagaatgcaagtgtcacctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctcccctgcctctctactgggcctgccaagggtgcgtcctaaccagcgtctgggtcatagcccacgagtgcggccaccacgccttcagcgactac

SEQ ID NO: 9557 - DNA, 349 bp, Artificial
  Mutation in BnaC.FAD2.a introduced by TALE nuclease pair BnFAD2_T01
caggatccatgggtgcaggtggaagaatgcaagtgtctcctccacccaagaagtctgaaaccgacaccatcaagcgcataccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtgggcctctctactgggcctgccaaggctgcgtcctaacgggcctctgggtcatagcccacgagtgcggccaccacgccttcagcgactac

SEQ ID NO: 9558 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctttggcctctctactgggcctgccaagcgtgcgtcctaaccggcgtctgggtcatagcccacgagtgcggccaccacgccttcagcgactac

SEQ ID NO: 9559 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgccgccaccacttacttccctctcctccctcaccctctctcctactggcctctctactgggcctgccaagggtgcgtcctaacgggcctctgggtcatagcccacgagtgcggcctccacggcttcagcgactac

SEQ ID NO: 9560 - DNA, 328 bp, Artificial
  Mutation in BnaC.FAD2.a introduced by TALE nuclease pair BnFAD2_T01
caggatccatgggtgcaggtggaagaatgcaagtgtctcctccctccaagaagtctgaaacctacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgccaagggtgcgtcctaaccggcgtctgggtcatagcccacgagtgcggccaccacgccttcagcgacta

SEQ ID NO: 9561 - DNA, 344 bp, Artificial
  Mutation in BnaC.FAD2.a introduced by TALE nuclease pair BnFAD2_T01
caggatccatgggtgcaggtggaagaatgcaagtgtctcctccccccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 9562 - DNA, 339 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccatcaccctctctcctctctactgggcctgccaagggtgcgtcctaaccggcgtctgggtcatagcccacgagtgcggccaccacgccttcagcgactac

SEQ ID NO: 9563 - DNA, 343 bp, Artificial
  Mutation in BnaC.FAD2.a introduced by TALE nuclease pair BnFAD2_T01
caggatccatgggtgcaggtgcaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctggtacatcatcatagcctcctgcttctactacgtcgccaccacttacttccctctcctccctcaccctctctcctgcctctctactgtgcctgccaagggtgcgtcctaaccggcgtctgggtcatagcccacgagtgcggccaccacgccttcagcgactac

SEQ ID NO: 9564 - DNA, 346 bp, Artificial
  Mutation in BnaC.FAD2.a introduced by TALE nuclease pair BnFAD2_T01
caggatccatgggtgcagggggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 9565 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcatcgactac

SEQ ID NO: 9566 - DNA, 321 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaaccggcgtctgggtcatagcccacgagtgcggccaccacgccttcagcgactac

SEQ ID NO: 9567 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccttggcctctctactgggcctgccaagggtgcgtcctaacgggcctctgggtcatcgcccacgaatgcggccaccacgccttcagcgactac

SEQ ID NO: 9568 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttggcctctctactgggcctgccaagggtgcgtcctaaccggcgtctgggtcatagcccacgagtgcggccaccacgccttcagcgactac

SEQ ID NO: 9569 - DNA, 318 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccaagggtgcgtcctaaccggcgtctgggtcatagcccacgagtggggccaccacgccttcagcgactac

SEQ ID NO: 9570 - DNA, 321 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaaccggcgtctgggtcatagcccgcgagtgcggccaccacgccatcagcgactac

SEQ ID NO: 9571 - DNA, 332 bp, Artificial
  Mutation in BnaC.FAD2.a introduced by TALE nuclease pair BnFAD2_T01
caggatccatgggtgcaggtgcaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccacgacgccttcagcgactac

SEQ ID NO: 9572 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctccctctctactgggcctgccaagggtgcgtcctaacgggcctctgggtcatagcccacgagtgcggccaccacgccttcagcgactac

SEQ ID NO: 9573 - DNA, 348 bp, Artificial
  Mutation in BnaC.FAD2.a introduced by TALE nuclease pair BnFAD2_T01
caggatccatgggtgcaggggcaagaatgcaagtgtcacattccaccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgtgcctgccaagggtgcgtcctaaccggcgtctggggcatagcccgcgagtgctgccaccacgccttcagcgactac

SEQ ID NO: 9574 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtccgaaccggcgtctgggtcatagcccgcgagtgcggccaccacgccatcagcgactac

SEQ ID NO: 9575 - DNA, 349 bp, Artificial
  Mutation in BnaC.FAD2.a introduced by TALE nuclease pair BnFAD2_T01
caggatccatgggtgcaggtagaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccccccctctcccttaccttggcccctctactgggcctgccaaggctgcgtcctaacgggcctctgggtcatcgcccacgaatgcggccaccacgccttcatcgactac

SEQ ID NO: 9576 - DNA, 300 bp, Artificial
  Mutation in BnaC.FAD2.a introduced by TALE nuclease pair BnFAD2_T01
caggatccatgggtgcaggtggaagaatgcaagtgtctcatccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccaagggtgcgtcctaaccggcgtctgggtcatagcccacgagtgcggcgaccacgccttcagcgactac

SEQ ID NO: 9577 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgccctctctactgggcctgccaagggtgcgtcctaaccggcgtctgggtcatagcccacgagtgcggccaccacgccttcagcgactac

SEQ ID NO: 9578 - DNA, 339 bp, Artificial
  Mutation in BnaC.FAD2.a introduced by TALE nuclease pair BnFAD2_T01
caggatccatgggtgcaggtggaagaatgcaagtctatcctccctccagctcccccgaaaccaaaaccctcaaacgcgtcccctgcgagacaccacccttcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctctctactgggcctgccaagggtgcgtcctaaccggcgtctgggtcatagcccacgagtgcggccaccacgccttcagctactac

SEQ ID NO: 9579 - DNA, 347 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccaacaagcgcgtaccctgcgagacaccgcccttcactgtcggagaactcaagaaagcaatcccaccgcactgtttcaaacgctcgatcccgcgctctttctcctacctcatctgggacatcatcatagcctcctgcttctactacgtcgccaccacttacttccctctcctccctcaccctctctccacctggcctcgctactgggcctgccaagggtgcgtcctaaccggcgtctgggtcatagcccacgagtgttgccaccacgccttcagcgactac

SEQ ID NO: 9580 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggtgcctggcctctctactgggcctgccaaggctgcgtcctaacgggcctctgggtcatcgcccacgagtgcggccaccacgccttcagcgactac

SEQ ID NO: 9581 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgcgcctgccaagggtgcgtcctaaccggcgtctgggtcatagcccacgagtgcggccaccacgccttcagcgactac

SEQ ID NO: 9582 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggccggccaagggtgcgtccgaaccggcgtctgggtcatagcccacgagtgcggccaccacgccttcagcgactac

SEQ ID NO: 9583 - DNA, 390 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcgatggccaccacctgctggggggtcaagccgtgggcggcctctctactgggcctgccaagggtgcgtccgaaccggcgtctgggtcatagcccacgagtgcggccaccacgccttcagcgactac

SEQ ID NO: 9584 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcggcctctctactgggcctgccaagggtgcgtcctaaccggcgtctgggtcatagcccacgagtgcggccaccacgccttcagcgactac

SEQ ID NO: 9585 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtctggcctctctactgggcctgccaagagtgcgtcctaaccggcgtctgggtcatagcccacgagtgcggccaccacgccttcagcgactac

SEQ ID NO: 9586 - DNA, 403 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcggatacctgtccgcctttctcccttcgggaagcgtggcgctttctcatagctcaggcctctctactgggcctgccaagggtgcgtcctaaccgtcgtctgggtcatagccctcgagtgcggccaccacgccttcagcgactac

SEQ ID NO: 9587 - DNA, 332 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggaactgccaagggtgcgtcctaaccggcgtctgggtcatagcccacgagtgcggcccccacgccttcagcgactac

SEQ ID NO: 9588 - DNA, 393 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgaacggtgcaggcgctgttgccggtgctgtgccaggcccacggcttgacccctggcctctctacggggcctgccaagggtgcgtcctaaccggcgtctgggtcatagcccacgagtgcggccaccacgccttcagcgactac

SEQ ID NO: 9589 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctggcctctctactgggcctgccaagggtgcgtcctaacgggcctctgggtcatcgcccacgaatgcggccaccacgccttcagcgactac

SEQ ID NO: 9590 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcgctcccctctctactgggcctgccaagggtgcgtcctaacgggcctctgggtcatagcccacgagtgcggccaccacgccttcagcgaccac

SEQ ID NO: 9591 - DNA, 323 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagggtgcgtcctaaccggcgtctgggtcatagcccacgagtgcggccaccacgccttcagcgactac

SEQ ID NO: 9592 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctacggggcctgccaagggtgcgtcctaaccgacgtctgggtcatagcccacgagtgcggccaccacgccttcagcgactac

SEQ ID NO: 9593 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccggcctctctactgggcctgccaagggtgcgtcctaaccggcgtctgggtcatagcccacgagtgcggccaccacgccttcagcgactac

SEQ ID NO: 9594 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgtgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccactggcctctctactgggcctgccaagggtgcgtcctaaccggcgtctgggtcatagcccacgagtgcggccaccacgccttcagcgactac

SEQ ID NO: 9595 - DNA, 351 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcctctctactgggcctgccaagggtgcgtcctaacgggcctctgggtcatcgcccacgaatgcggccaccacgccttcagcgactac

SEQ ID NO: 9596 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaaccggcgtctgggtcatagcccatgagtgcggccaccacgccttcagcgactac

SEQ ID NO: 9597 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccatctctcctacttttggcctctctactgggcctgccaagggtgcgtcctaaccggcgtctgggtcatagcccacgagtgcggccaccacgccttcagcgactac

SEQ ID NO: 9598 - DNA, 350 bp, Artificial
  Mutation in BnaC.FAD2.a introduced by TALE nuclease pair BnFAD2_T01
caggatccatgggtgcaggcgcaagaatgcaagtctctcctccctccagctcccccgaaaccaaaaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 9599 - DNA, 419 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactaagactgggcctttcgttttatctgttgtttgtcggtgaacgctctcctgagtaggacaaatccgctcccttggcttttttactgggcctgccaaggctgcgtcctaacgggcctctgggtcatcgcccacgaatgcggccaccacgccttcagcgactac

SEQ ID NO: 9600 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccgcctggcctctctactgggcctgccaagggtgcgtcctaaccggcgtctgggtcatagcccacgagtgcggccaccacgccttcagcgactac

SEQ ID NO: 9601 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagcaagcaatcccaccgcactgtttcaaacgctcgatccctcgctctttctcctacctcatctgggacatcatcatagcctcctgcttctactacgtcgccaccccttacttccctctcctccctcaccctctctcctccttcgccgcctggcctctctactgggcctgccaagggtgcgtcctaaccggcgtctgggtcatagcccacgagtgcggccaccacgccttcagcgactac

SEQ ID NO: 9602 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctctctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 9603 - DNA, 409 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcaaataatgattttattttgactgatagtgacctgttcgttgcaacaaattgatgagctctctactgggcctgccaagggtgcgtcctaaccggcgtctgggtcatagcccacgagtgcggccaccacgccttcagcgactac

SEQ ID NO: 9604 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgtctctctactgggcctgtcaagggtgcgtcctaaccggcgtctgggtcatagcccacgagtgcggccaccacgccttcagcgactac

SEQ ID NO: 9605 - DNA, 350 bp, Artificial
  Mutation in BnaC.FAD2.a introduced by TALE nuclease pair BnFAD2_T01
caggatccatgggtgcaggtggaagaatgcaagtgtcccctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttctggcctctctactgggcctgccaagggtgcgtcctaaccggcgtctgggtcatagcccacgagtgcggccaccacgccttcagcgactac

SEQ ID NO: 9606 - DNA, 424 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccccagcgcctgcttgccgccatcgtggctggcgttggccaccacctgctccggggtcaagccgtgggcctggcatggcctctctactgggcctgccaagggtgcgtcctaaccggcgtctgggtcatagcccacgagtgcggccaccacgccttcagcgactac

SEQ ID NO: 9607 - DNA, 401 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccttcaccctctctcctacgtcgccataaactgccaggcatcaaactaagcagaaggccatccgtccataggctggcctctctactgggcctgccaagggtgcgtcctaaccggcgtctgggtcatagcccacgagtgcggccaccacgccttcagcgactac

SEQ ID NO: 9608 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccatctcatccctcaccctctctcctactttggcctctctactgggcctgccaagggtgcgtcctaaccggcgtctgggtaatagcccacgagtgcggccaccacgccttcagcgactac

SEQ ID NO: 9609 - DNA, 314 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctacctcctcttcgacatcctcgtctcctcctccctcaccctctctcctacttgctggcctctctactgggcctgccaagggtgcgtcctaaccggcgtctgggtcatagcccacgagtgcggccaccacgccttcagcgactac

SEQ ID NO: 9610 - DNA, 355 bp, Artificial
  Mutation in BnaC.FAD2.a introduced by TALE nuclease pair BnFAD2_T01
caggatccatgggtgcaggcggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcgctggcctctctactgggcctgccaagggtgcgtcctaaccggcgtctgggtcatagcccacgagtgcggccaccacgccttcagcgactac

SEQ ID NO: 9611 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatcttggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 9612 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttggcctctctactgggcctgccaaggctgcgtcctaacgggcctctgggtcatcgcccacgaatgcggccaccacgccttcagcgactac

SEQ ID NO: 9613 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctactgggcctgccaagggtgcgtcctaaccggcgtctgggtcatagcccacgagtgcggccaccacgccttcagcgactac

SEQ ID NO: 9614 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaaccggcgtctgggtcatagcccacgagtgcggccaccacgccttcagcgactac

SEQ ID NO: 9615 - DNA, 261 bp, Artificial
  Mutation in BnaC.FAD2.a introduced by TALE nuclease pair BnFAD2_T01
caggatccattggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 9616 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttgcctctctactgggcctgccaagggtgcgtcctaaccggcgtctgggtcatagcccacgagtgcggccaccacgccttcagcgactac

SEQ ID NO: 9617 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 9618 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctcctctctactgggcctgccaagggtgcgtcctaaccggcgtctgggtcatagcccacgagtgctgccaccacgccttcagcgactac

SEQ ID NO: 9619 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcgcctggcctctctactgggcctgccaagggtgcgtcctaacgggcctcttggtcatagcccacgagtgcggccaccacgccttcagcgactac

SEQ ID NO: 9620 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctgaccggcgtcggggtcatagcccaccagtgcggccaccaggccttcagcgactac

SEQ ID NO: 9621 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctaggcctctctactgggcctgccaagggtgcgtcctaaccggcgtctgggtcatggcccacgagtgcggccaccacgccttcagcgactac

SEQ ID NO: 9622 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgctgccaaggctgcgtcctaacgggcctctgggtcatcgcccacgaatgcggccaccacgccttcagcgactac

SEQ ID NO: 9623 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctggcctctctactgggcctgccaagggtgcgtcctaaccggcgtctgggtcatagcccacgagtgcggccaccacgccttcagcgactac

SEQ ID NO: 9624 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgtgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctgcctctctactgggcctgccaagggtgcgtcctaaccggcgtctgggtcatagcccacgagtgcggccaccacgccttcagcgactac

SEQ ID NO: 9625 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgctccctcgctctttctcctacctcatctgggacatcatcatagcctcctgcttctactacgtcgccaccacttacttccctctcctccctcaccctctcccctacttctctctactgggcctgccaagggtgcgtcctaaccggcgtctgggtcatagcccacgagtgcggccaccacgccttcagcgactac

SEQ ID NO: 9626 - DNA, 348 bp, Artificial
  Mutation in BnaC.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctcccccacttggcctctctactgggcctgccaagggtgcgtcctaaccggcgtctgggtcatagcccacgagtgcggccaccacgccttcagcgactac

SEQ ID NO: 9627 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcgtttggcctctctactgggcctgccaagggtgcgtcctaaccggcgtctgggtcatagcccacgagtgcggccaccacgccttcagcgactac

SEQ ID NO: 9628 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctgcctggcctctctactgggcctgccaagggtgcgtcctaaccggcgtctgggtcatagcccacgagtgcggccaccacgccttcagcgactac

SEQ ID NO: 9629 - DNA, 338 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactactgggcctgccaagggtgcgtcctaaccggcgtctgggtcatagcccacgagtgcggcctccacgccttcagcgactac

SEQ ID NO: 9630 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 9631 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtccccaccacttacttcccactcctccctcaccctctctcctactcctctctactgggcctgccaagggtgcgtcctaaccggcgtctgggtcatagcccacgagtgcggccaccacgccttcagcgactac

SEQ ID NO: 9632 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcataccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgcctctctactgggcctaccaagggtgcgtcctaaccggcgtctgggtcatagcccacgagtgcggccaccacgccttcagcgactac

SEQ ID NO: 9633 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccatcacgccttcagcgactac

SEQ ID NO: 9634 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaaggctgcgtcctaacgggcctctgggtcatagcccacgagtgcggccaccacgccttcagcgactac

SEQ ID NO: 9635 - DNA, 350 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctggcctctctactgggcctgccaagggggcgtcctaacgggcctctgggtcatagcccacgagtgcggccaccacgccttcagcgactac

SEQ ID NO: 9636 - DNA, 350 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaacgggcctctgggtcatagcccacgagtgcggccaccacgccttcagcgactac

SEQ ID NO: 9637 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactcctctctactgggcctgccaagggtgcgtcctaaccggcgtctgggtcatagcccacgagtgcggccaccacgccttcagcgactac

SEQ ID NO: 9638 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatcccacgctccttctcctcttcgacatcatcatctcctcctcggctcctccctctaccacctctccacagcctacttccctctctcctactttggcctctctactgggcctgccaagggtgcgtcctaaccggcgtctgggtcatagcccacgagtgcggccaccacgccttcagcgactac

SEQ ID NO: 9639 - DNA, 378 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagatctcaagaaagcaatcccaccgcactgtttcaaacgctcgatccctcgctctttctcctacctcatctgggacatcatcatagcctcctgcttctactacgtcgccaccacttacttccctctcctccctcaccctctctcctctttgatccggttcctgaacaggatctatttgatggcctctctactgggcctgccaagggtgcgtcctaaccggcgtctgggtcatagcccacgagtgcggccaccacgccttcagcgactac

SEQ ID NO: 9640 - DNA, 352 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccatcaagcgcgtaccctgcgagacaccgcccttcactgtcggagaactcaagaaagcaatcccaccgcactgtttcaaacgctcgatccctcgctctttctcctacctcatctgggacatcaccatagcctcctgcttctactacgtcgccaccacttacttccctctcctccctcaccctctctcctacttcgctggcctctctactgggcctgccaagggtgcgtcctaaccggcgtcttggtcatagcccacgagtgcggccaccacgccttcagcgactac

SEQ ID NO: 9641 - DNA, 334 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccacgagtgcggccaccacgccttcagcgactac

SEQ ID NO: 9642 - DNA, 277 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacgtccctctcctccctcaccctctcgccgactccacgccttcagcgactac

SEQ ID NO: 9643 - DNA, 328 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgccaagggtgcgtcctaaccggcgtctgggtcatagcccacgagtgcggccaccacgccttcagcgctac

SEQ ID NO: 9644 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatcgcccacgaatgcggccaccacgccttcagcgactac

SEQ ID NO: 9645 - DNA, 350 bp, Artificial
  Mutation in BnaC.FAD2.a introduced by TALE nuclease pair BnFAD2_T01
caggatccatggatgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 9646 - DNA, 353 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagccccctgcttctactacgtcgccaccacttactttcctctcctccctcaccctctcgcccgtctcccccggcctctctactgggcctgccaaggctgcgtcctaacgggcctctgggtcatagcccacgagtgcggccaccacgccttcagcgactac

SEQ ID NO: 9647 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaacgggcctctgggtcatcgcccacgaatgcggccaccacgccttcagcgactac

SEQ ID NO: 9648 - DNA, 413 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacccggcggatttgtcctactcaggagagcgttcaccgacaaacaacagataaaacgaaaggcccagtcggcctctctactggacctgccaagggtgcgtcctaaccggcgtctgggtcatagcccacgagtgcggccaccacgccttcagcgactac

SEQ ID NO: 9649 - DNA, 413 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacccggcggatttgtcctactcaggagagcgttcaccgacaaacaacagataaaacgaaaggcccagtcggcctctctactggacctgccaagggtgcgtcctaaccggcgtctgggtcatagcccacgagtgcggccaccacgccttcagcgactac

SEQ ID NO: 9650 - DNA, 300 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccaaggatgcgtcctaaccggcgtctgggtcatagcccacgagtgcggccaccacgccttcagcgactac

SEQ ID NO: 9651 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcccctctactgggcctgccaaggctgcgtcctaacgggcctctgggtcatcgcccacgaatgcggccaccacgccttcagcgactac

SEQ ID NO: 9652 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcccctctactgggcctgccaaggctgcgtcctcacgggcctctgggtcatcgcccacgaatgcggccaccacgccttcagcgactac

SEQ ID NO: 9653 - DNA, 322 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaagggtgcgtcctaaccggcgtctgggtcatagcccacgagtgcggccaccacgccttcagcgactc

SEQ ID NO: 9654 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccccccctctcccttacctggcccctctactgggcctgccaaggctgcgtcctaacgggcctctgggtcatcgcccacgaatgcggccaccacgccttcagcgactac

SEQ ID NO: 9655 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggacaccacgccttcagcgactac

SEQ ID NO: 9656 - DNA, 334 bp, Artificial
  Mutation in BnaC.FAD2.a introduced by TALE nuclease pair BnFAD2_T01
caggatccatgggtgcaggtggaagaatgcaagtgtctcctccctccaataagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctgccaatggtgcgtcctaaccggcgtctgggtcatagcccacgagtgcggccaccacgccttcagcgactac

SEQ ID NO: 9657 - DNA, 356 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcccctctactgggcctgccaaggctgcgtcctaacgggcctctgggtcatcgcccacgaatgcggccaccacgccttcagcgactac

SEQ ID NO: 9658 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacactctctcctactttggcctctctactgggcctgccaagggtgcgtcctaaccggcgtctgggtcatagcccacgagtgcggccaccacgccttcagcgactac

SEQ ID NO: 9659 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctggtacatcatcatagcctcctgcttctactacgtcgccaccacttacttccctctcctccctcaccctctctctgcctctctactgggcctgccaagggtgcgtcctaaccggcgtctgggtcatagcccacgagtgcggccaccacgccttcagcgactac

SEQ ID NO: 9660 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgggcctctctactgggcctgccaagggtgcgtcctaaccggcgtcggggtcatagcccacgagtgcggccaccacgccttcagcgactac

SEQ ID NO: 9661 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgcgacatcatcatagcctcctgcttctactacgtcgccaccacttacttccctctcctccctcaccctctctcctacgcctggcctctctactgggcctgccaagggtgcgtcctaaccggcgtctgggtcatagcccacgagtgcggccaccacgccttcagcgactac

SEQ ID NO: 9662 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccgcctggcctctctactgggcctgccaagggtgcgtcctaacctgcgtctgggtcatagcccacgagtgcggccaccacgccttcagcgactac

SEQ ID NO: 9663 - DNA, 401 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctcccctacttcggcccagcgcctgcttgccaccattattgctggcgatggccaccacctgctgggcctctctactgggcctgccaagggtgcgtcctaaccggcgtctgggtcatagcccacgagtgcggccaccacgccttcagcgactac

SEQ ID NO: 9664 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccgccgcactgtttcaaacgctcgatccctcgctctttctcctacctcatctgggacatcatcatagcctcctgcttctactacgtcgccaccacttacttccctctcctccctcaacctctctcctacttggcctctctactgggcctgccaagggtgcgtcctaaccggcgtctgggtcatagcccacgagtgcggccaccacgccttcagcgactac

SEQ ID NO: 9665 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttcccactcctccctcaccctctctcctaggcctctctactgggcctgccaagggtgcgtcctaaccggcgtctgggtcatagcccacgagtgcggccaccacgccttcagcgacta

SEQ ID NO: 9666 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtccgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 9667 - DNA, 343 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 9668 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccttggcctctctactgggcctgccaagggtgcgtcctaaccggcgtctgggtcatagcccacgagtgcggccaccacgccttcagcgactac

SEQ ID NO: 9669 - DNA, 441 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctggtggccaccgccagccacgatggtggcaagcaggcgctggagacggtccagcggctgttgccggtgctgtgccaggcccacggcttgacccctggcctctctactgggcctgccaagggtgcgtcctaaccggcgtctgggtcatagcccacgagtgcggccaccacgccttcagcgactac

SEQ ID NO: 9670 - DNA, 347 bp, Artificial
  Mutation in BnaC.FAD2.a introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatatcccacgagtgcggccaccacgccttcagcgactac

SEQ ID NO: 9671 - DNA, 347 bp, Artificial
  Mutation in BnaC.FAD2.a introduced by TALE nuclease pair BnFAD2_T01
caggatccatgggtgcaggtggaagaatgcaagtgtctcctccccccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgactggcctctctactgggcctgccaagcgtgcgtcctaaccggcgtctgggtcatagcccacgagtgcggccaccacgccttcagcgactac

SEQ ID NO: 9672 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 9673 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactccgctggcctctctactgggcctgccaagggtgcgtcctaaccggcgtctgggtcatagcccacgagtgcggccaccacgccttcagcgactac

SEQ ID NO: 9674 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactgtcggagacctcaagaaagcaatcccaccgcactgtttcaaacgctcgatccctcgctctttctcctacctcatctggtacatcatcatagcctcctgcttctactacgtcgccaccacttacttccctctcctccctcaccctctctcctccgctggcccctctactgggcctgccaagggtgcgtcctcaccggcgtctgggtcatagcccacgagtgcggccaccacgccttcagcgactac

SEQ ID NO: 9675 - DNA, 339 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgggtcatagcccacgagtgcggccaccacgccttcagcgactac

SEQ ID NO: 9676 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccccctcttacttccctctcctccctcaccctcgctcctactggcctctctactgggcctgccaagggtgcgtcctaaccggcgtctgggtcatagcccacgagtgcggccaccacgccttcagcgactac

SEQ ID NO: 9677 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttggcctctctactgggcctgccaagggtgcgtcctaaccggcgtctgggtcatagcccacgagtgcggccaccacgccttcagcgactac

SEQ ID NO: 9678 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcatctgggacatcatcatagcctcctgcttctactacgtcgccaccacttacttccctctcctccctcaccctctctcctaatggcctctctactgggcctgccaagggtgcgtcctaaccggcgtctgggtcatagcccacgagtgcggccaccacgccttcagcgactac

SEQ ID NO: 9679 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacacctcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 9680 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcccacctcatctgggacatcatcatagcctcctgcttctactacgtcgccaccacttacttccctctcctccctcaccctctctcctcctttggcctctctactgggcctgccaagggtgcgtcctaaccggcgtctgggtcatagcccacgagtgcggccaccacgccttcagcgactac

SEQ ID NO: 9681 - DNA, 359 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttcccctacctcctcttcgacatcatcatctcctcctcggctcctccctctaccacctctccacagcctacttccctctcctccctcaccctctctcctacttcctggcctctctactgggcctgccaagggtgcgtcctaaccggcgtctgggtcatagcccacgagtgcggccaccacgccttcagcgactac

SEQ ID NO: 9682 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaacctacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacctctctactgggcctgccaaggctgcgtcctaacgggcctctgggtcatagcccacgagtgcggccaccacgccttcagcgactac

SEQ ID NO: 9683 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaacctacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaaggctgcgtcctaacgggcctctgggtcatagcccacgagtgcggccaccacgccttcagcgactac

SEQ ID NO: 9684 - DNA, 401 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgtcaccacttacttccctctcctccctcaccctctctcctacttcggtccagcgcctgcttgccaccattattgctggcgattgccaccacctgctgggcctctctactgggcctgccaagggtgcgtcctaaccggcgtctgggtcatagcccacgagtgcggccaccacgccttcagcgactac

SEQ ID NO: 9685 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcatactgggcctgccaagggtgcgtcctaacgggcctctgggtcatagcccacgagtgcggccaccacgccttcagcgactac

SEQ ID NO: 9686 - DNA, 277 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgccgcctccgcgccttcagcgactac

SEQ ID NO: 9687 - DNA, 424 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgctgctccagcgccggcttgccgccatcgtggcgggcgatggccaccacctgctggggggtcaagccgtgggcctggcatggcctctctaatgggcctgccaagggtgcgtcctaaccggcctctgggtcatagcccacgagtgcggccaccacgccttcagcgactac

SEQ ID NO: 9688 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaaggctgcgtcctaacgggcctctgggtcatagcccacgagtgcggccaccacgccttcagcgactac

SEQ ID NO: 9689 - DNA, 385 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccgtgggcctgccccagcaccggcaacagccgctggaccgtctccagcgcctgcctggcctctctactgggcctgccaagggtgcgtcctaaccggcgtctgggtcatagcccacgagtgcggccaccacgccttcagcgactac

SEQ ID NO: 9690 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactatgtcgccaccacttacttccctctcctccctcaccctctctcctagcctctctactggacctgccaagggtgcgtcctaaccggcgtctgggtcatagcccacgagtgcggccaccacgccttcagcgactac

SEQ ID NO: 9691 - DNA, 300 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtctctctactgggcctgccaagggtgcgtcctaactggcgtctgggtcatagcccacgagtgcggccaccacgccttcagcgactac

SEQ ID NO: 9692 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcacctgggacatcatcatagcctcctgcttctactacgtcgctaccacttacttccctcgcctccctcaccctctctcctacattggcctctctacagggcctgccaagagtgcgtcctaaccggcgtctgggtcatagcccgcgagtgcggccaccacgccatcagcgactac

SEQ ID NO: 9693 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcacctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaacgggcctctgggtcatagcccacgagtgcggccaccacgccttcagcgactac

SEQ ID NO: 9694 - DNA, 358 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctaacctggcctctctactgggcctgccaagggtgcgtcctaaccggcgtctgggtcatagcccatgagtgcggccaccacgccttcagcgactac

SEQ ID NO: 9695 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttccctggcccctctactgggcctgccaaggctgcgtcctaaccggcgtctgggtcatagcccacgagtgcggccaccacgccttcagcgactac

SEQ ID NO: 9696 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgatacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 9697 - DNA, 355 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctttggcctctctactgggcctgccaagggtgcgtcctaaccggcgtctgggtcatagcccacgagtgcggccaccacgccttcagcgactac

SEQ ID NO: 9698 - DNA, 355 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccaagggtgcgtcctaaccggcgtctgggtcatagcccacgagtgcggccaccacgccttcagcgactac

SEQ ID NO: 9699 - DNA, 347 bp, Artificial
  Mutation in BnaC.FAD2.a introduced by TALE nuclease pair BnFAD2_T01
caggatccattggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctactttcctctctactgggcctgccaagggtgcgtcctaaccggcgtctgggtcatagcccacgagtgcggccaccacgccttcagcgactac

SEQ ID NO: 9700 - DNA, 314 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctcaccctctctcctacttctggcctctctactgggcctgccaagggtgcgtcctaaccggcgtctgggtcatagcccacgagtgcggccaccacgccttcagcgactac

SEQ ID NO: 9701 - DNA, 321 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaaccggcgtctgggtcacagcccacgagtgcggccaccacgccttcagcgactac

SEQ ID NO: 9702 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccttggcctctctactgggcctgccaagggtgcgtcctaaccggcgtctgggtcatagcccacgagtgcggccaccacgccttcagcgactac

SEQ ID NO: 9703 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctgccaagggtgcgtcctaaccggcgtctgggtcatagcccacgagtgcggccaccacgccttcagcgactac

SEQ ID NO: 9704 - DNA, 305 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgccatcgtggctggcgatggccaccacgccttcagcgactac

SEQ ID NO: 9705 - DNA, 398 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctcttcctcctacctcatctgggacatcatcatagcctcctgcttctactacgtcgccaccacttacttccctctcctccctcaccctctctgccaacttctcaagattgcaaaacgtggcggcgtgaccgcagtggaggcagtgcatgcgcctctctactgggcctgccaagggtgcgtcctaaccggcgtctgggtcatagcccacgagtgcggccaccacgccttcagcgactac

SEQ ID NO: 9706 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattggcctctctactgggcctgccaagggtgcgtcctaaccggcgtctgggtcatagcccacgagtgcggccaccacgccttcagcgactac

SEQ ID NO: 9707 - DNA, 344 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctactgggcctgccaagggtgcgtcctaaccggcgtctgggtcatagcccacgagtgcggccaccacgccttcagcgactac

SEQ ID NO: 9708 - DNA, 350 bp, Artificial
  Mutation in BnaC.FAD2.a introduced by TALE nuclease pair BnFAD2_T01
caggatccatgggtgcaggtggaagaatgcaagtgtctcctcctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgaggcctctctactgggcctgccaagggtgcgtcctaaccggcgtctgggtcatagcccacgagtgcggccaccacgccttcagcgactac

SEQ ID NO: 9709 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 9710 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcggcctctctactgggcctgccaagggtgcgtcctaaccggcgtctgggtcatagcccacgagtgcggccaccacgccttcagcgactac

SEQ ID NO: 9711 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttctctctactgggcctgccaagggtgcgtcctaaccggcgtctgggtcatagcccacgagtgcggccaccacgccttcagcgactac

SEQ ID NO: 9712 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcctctactacgtcgccactacttatttccctcccctccctcaccctctcccccactcctctctactgggcctgccaagggtgcgtcctaaccggcgtctgggtcatagcccacgagtgcggccaccacgccttcagcgactac

SEQ ID NO: 9713 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctggcacatcatcatagcctcctgcttctactacgtcgccaccacttacttccctctcctccctcaccctctctcctacgtctggcctctctactgggcctgccaagggtgcgtcctaaccggcgtctgggtcatagcccacgagtgcggccaccacgccttcagcgactac

SEQ ID NO: 9714 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgctgccaagggtgcgtcctaaccggcgtctgggtcatagcccacgagtgcggccaccacgccttcagcgactac

SEQ ID NO: 9715 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcatctgggacatcatcatagcctcctgcttctactacgtcgccaccacttacttccctctcctccctcaccctctctcctactctcctctctactgggcctgccaagggtgcgtcctaaccggcgtctgggtcatagcccacgagtgcggccaccacgccttcagcgactac

SEQ ID NO: 9716 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcccctctactgggcctgccaaggctgcgtcctaacgggcctctgggtcatcgcccacgaatgcggccaccacgccttcagcgactac

SEQ ID NO: 9717 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggcctgccaaggctgcgtcctaacgggcctctgggtcatagcccacgagtgcggccaccacgccttcagcgactac

SEQ ID NO: 9718 - DNA, 314 bp, Artificial
  Mutation in BnaC.FAD2.a introduced by TALE nuclease pair BnFAD2_T01
caggagccatgggtgcaggtggaagaatgcaagtgtctactccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactaagtcgccaccacttacttccctctcctccctcaccctctctcaagtgtgcgtcctaaccggcgtctgtgtcatagcccacgagtgctgccaccacgcctgcagcgactac

SEQ ID NO: 9719 - DNA, 331 bp, Artificial
  Mutation in BnaC.FAD2.a introduced by TALE nuclease pair BnFAD2_T01
caggatccatggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcagcctctctactgggcctgccaagggtgcgtcctaaccggcgtctgggtcatagcccacgagtgcggccaccacgccttcagcgactac

SEQ ID NO: 9720 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgaatgcggccaccacgccttcagcgactac

SEQ ID NO: 9721 - DNA, 323 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaaggctgcgtcctaacgggcctctgggtcatagcccacgagtgcggccaccacgccttcagcgactac

SEQ ID NO: 9722 - DNA, 387 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccgccatcgtggctggcgatggccaccccctgctcctggcctctctactgggcctgccaaggctgcgtcctaacgggcctctgggtcatcgcccacgaatgcggccaccacgccttcagcgactac

SEQ ID NO: 9723 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaagggtgcgtcctaaccggcgtctgggtcatagcccacgagtgcggccaccacgccatcagcgactac

SEQ ID NO: 9724 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctcccctacttctctctactgggcctgccaagggtgcgtcctaaccggcgtctgggtcatagcccacgagtgcggccaccacgccttcagcgactac

SEQ ID NO: 9725 - DNA, 340 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccccccctctccctccctctactgggcctgccaaggctgcgtcctaacgggcctctgggtcatcgcccacgaatgcggccaccacgccttcagcgactac

SEQ ID NO: 9726 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgttctaaccggcgtctgggtcatagcccacgagtgcggccaccacgccttcagcgactac

SEQ ID NO: 9727 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 9728 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattggcctctctactgggcctgccaagggtgcgtcctaaccggcgtctgggtcatagcccacgaatgcggccaccacgccttcagcgactac

SEQ ID NO: 9729 - DNA, 312 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 9730 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcctcgtctcctcctccctctaccacctctccacagcctacttccctctcctcccccaccctctctcctacttcggcctctctactgggcctgccaagggtgcgtcctaaccggcgtctgggtcatagcccacgagtgcggccaccacgccttcagcgactac

SEQ ID NO: 9731 - DNA, 351 bp, Artificial
  Mutation in BnaC.FAD2.a introduced by TALE nuclease pair BnFAD2_T01
caggatccatgtgtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgggcctctctactgggcctgccaagggtgcgtcctaaccggcgtctgggtcatagcccacgagtgcggccaccacgccttcagcgactac

SEQ ID NO: 9732 - DNA, 380 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacaccatcatagcctcctgcttctactacgtcgccaccacttacttccctctcctccctcaccctctctcctacttcacagtggtccggcgcccgcgctctggaggcctgcctctctactgggcctgccaagggtgcgtcctaaccggcgtctgggtcatagcccacgagtgcggccaccacgccttcagcgactac

SEQ ID NO: 9733 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccaagggtgcgtcctaaccggcgtctgggtcatagcccacgagtgcggccaccacgccttcagcgactac

SEQ ID NO: 9734 - DNA, 354 bp, Artificial
  Mutation in BnaC.FAD2.a introduced by TALE nuclease pair BnFAD2_T01
caggatccatgggtgcaggtggaagaatgcaagtgtctcctccctacaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctctccctctctcctacttcgccctggcctctctactgggcctgccaagggtgcgtcctaaccggcgtctgggtcatagcccacgagtgcggccaccacgccttcagcgactac

SEQ ID NO: 9735 - DNA, 354 bp, Artificial
  Mutation in BnaC.FAD2.a introduced by TALE nuclease pair BnFAD2_T01
caggatccatgggtgcaggtggaagaatgcaagtgtctcctccctacaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgccctggcctctctactgggcctgccaagggtgcgtcctaaccggcgtctgggtcatagcccacgagtgcggccaccacgccttcagcgactac

SEQ ID NO: 9736 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattggcctctctactgggcctgccaagggtgcgtcctaacgggcctctgggtcatagcccacgagtgcggccaccacgccttcagcgactac

SEQ ID NO: 9737 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccctggcccctctactgggcctgccaaggctgcgtcctaacgggcctctgggtcatcgcccacgaatgcggccaccacgccttcagcgactac

SEQ ID NO: 9738 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagggactac

SEQ ID NO: 9739 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaacgggcctctgggtcatcgcccacgaatgcggccaccacgccttcagcgactac

SEQ ID NO: 9740 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttggcctctctactgggcctgccaagggtgcgtcctaaccggcgtctgggtcatagcccacgagtgcggccaccacgccttcagcgactac

SEQ ID NO: 9741 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctctatccctcgctctttctcctacctcatctgggacatcatcatagcctcctgcttctactacgtcgccaccacttacttccctctcctccctcaccctctctcctacttcggcctctctactgggcctgccaaggttgcgtcctaaccggcgtctgggtcatagcccacgagtgcggccaccacgccttcagcgactac

SEQ ID NO: 9742 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccccctctcctacttggcctctctactgggcctgccaagggtgcgtcctaaccggcgtctgggtcatagcccacgagtgcggccaccacgccttcagcgactac

SEQ ID NO: 9743 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttagcctgccaagggtgcgtcctaacgggcctctgggtcatcgcccacgaatgcggccaccacgccttcagcgactac

SEQ ID NO: 9744 - DNA, 350 bp, Artificial
  Mutation in BnaC.FAD2.a introduced by TALE nuclease pair BnFAD2_T01
caggatccaatgggtgcaggtggaagaatgcaagtgtctcctccctccaagaagtctgaaaccgacaccatcaagcgcgtaccctgcgagacaccaccattcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 9745 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacctctggcctctctacttggcctgccaagggtgcgtcctaaccggcgtctgggtcatagcccacgagtgcggccaccacgccttcagcgactac

SEQ ID NO: 9746 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaaccggcgtctgggtcatagcccacgagtgcggccaccacgccttcagcgactac

SEQ ID NO: 9747 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcctggcctctctactgggcctgccaaggctgcgtcctaacgggcctctgggtcatagcccacgagtgcggccaccacgccttcagcgactac

SEQ ID NO: 9748 - DNA, 339 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgggtcatagcccacgagtgcggccaccccgccttcagcgactac

SEQ ID NO: 9749 - DNA, 348 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccaattacttccctctcctccctcaccctctctcctacttggcctctctactgggcctgccaagggtgcgtcctaaccggcgtctgggtcatagcccacgagtgcggccaccacgccttcagcgactac

SEQ ID NO: 9750 - DNA, 314 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcaagtgtgcgtcctaaccggcgtctgggtcatagcccacgagtgcggccaccacgccttcagcgactac

SEQ ID NO: 9751 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacactacccttcactctcggagacctcaagaaagcaatcccaccacactgtttcaaacgctcgatccctcgctctttctcctacctcatctgggacatcatcatagcctcctgcttctactacgtcgccaccacgtacttccctctcctccctcaccctctcacctacttacctctctacggggcctgccaagggtgcgtcctaaccggcgtctgggtcatagcccacgagtgcggccaccacgccatcagcgactac

SEQ ID NO: 9752 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 9753 - DNA, 344 bp, Artificial
  Mutation in BnaC.FAD2.a introduced by TALE nuclease pair BnFAD2_T01
caggatccatgggtgcaggtggaagaatgcaagtgtctcctccctccagttcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaacgggcctctgggtcatcgcccacgaatgcggccaccacgccttcagcgactac

SEQ ID NO: 9754 - DNA, 341 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctatctctactgggcctgccaagggtgcgtcctaaccggcgtctgggtcatagcccacgagtgcggccaccacgccttcagcgactac

SEQ ID NO: 9755 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctactttggcctctctactgggcctgccaagggtgcgtcctaaccggcgtctgggtcatagcccacgagtgcggccaccacgccttcatcgactac

SEQ ID NO: 9756 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatccgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 9757 - DNA, 395 bp, Artificial
  Mutation in BnaC.FAD2.a introduced by TALE nuclease pair BnFAD2_T01
caggatccatgggtgcaggaggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttcgccgcaaactcttcctggctagcggtacgcgtattaattgcgtcctggcctctctactgggcctgccaagggtgcgtcctaaccggcgtctgggtcatatcccacgagtgcggccaccacgccctcagcgactac

SEQ ID NO: 9758 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtcttggtcatagcccacgagtgcggccaccacgccttcagcgactac

SEQ ID NO: 9759 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacctctctactgggcctgccaagggtgcgtcctaaccggcgtctgggtcatagcccacgagtgcggccaccacgccttcagcgactac

SEQ ID NO: 9760 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctcttcgacatcatcatctcctcctcggctcctccctctaccacctctccacagcctacttccctctcctccccccccctcccccttacggcccctctactgggcctgccaaggctgcgtcctaacgggcctctgggtcatcgcccacgaatgcggccaccacgccttcagcgactac

SEQ ID NO: 9761 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 9762 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctccttcctccggcctctctactgggcctgccaagggtgcttcctaacggggctcttggtcattacccacgagtgcggccacctcgccttcagcgactac

SEQ ID NO: 9763 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctggcctctctactgggcctgccaagggtgcgtcctaaccggcgtctgggtcatagcccacgagtgcgtccaccacgccttcagcgactac

SEQ ID NO: 9764 - DNA, 337 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcgcctctactgggcctgccaagggtgcgtcctaaccggcgtctgggtcatagcccacgagtgcggccaccacgccttcagcgactac

SEQ ID NO: 9765 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgtcaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 9766 - DNA, 451 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactaacagaaattatatgataatcatcgcaagaccggcagcaggattcaatcttaagaaactttattgccaaatgtttgaaacgaccttttggaaacttcggcttcctggcctctctactgggcctgccaagggtgcgtcctaaccggcgtctgggtcatagcccacgagtgcggccaccacgccttcagcgacta

SEQ ID NO: 9767 - DNA, 357 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactatgtcgccaccacttacttccctctcctccctcaccggtttgcgtattgccggtgcctggcctctctactgggcctgccaagggtgcgtcctaacgggcctctgggtcatcgcccacgaatgcggccaccacgccttcagcgactac

SEQ ID NO: 9768 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcaccatagcctcctgcttctactacgtcgccaccacttacttccctctcctccctcaccctctctcctacttttggcctctctactgggcctgccaaggctgcgtcctaacgggcctctgggtcatagcccacgagtgcggccaccacgccttcagcgactac

SEQ ID NO: 9769 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccctcctctctactgggcctgccaagggtgcgtcctaacgggcctctgggtcatcgcccacgaatgcggccaccacgccttcagcgactac

SEQ ID NO: 9770 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaaggctgcgtcctaacgggcctctgggtcatagcccacgagtgcggccaccacgccttcagcgactac

SEQ ID NO: 9771 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctggaactgccaagggtgcgtcctaaccggcgtctgggtcatagcccacgagtgcggccaccacgccttcagcgactac

SEQ ID NO: 9772 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacttcatcatagcctcctgcttctactacgtcgccaccacttacttccctctcctccctcaccctctccctctctactgggcctgccaagggtgcgtcctaaccggcgtctgggtcatagcccacgagtgcggccaccacgccttcagcgactac

SEQ ID NO: 9773 - DNA, 329 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctactgccaagggtgcgtcctaaccggcgtctgggtcatagcccacgagtgcggccaccacgccttcagcgactac

SEQ ID NO: 9774 - DNA, 329 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctactgccaagggtgcgtcctaaccggcgtctgggtcatagcccacgagtgcggccaccacgccttcagccactaa

SEQ ID NO: 9775 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctactttggcctctctactgggcctgccaagggtgcgtcctaaccggcgtcggggtcatagcccacgagtgcggccaccacgccttcagcgactac

SEQ ID NO: 9776 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacgtcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 9777 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtccgaaccggcgtctgggtcatagcccacgagtgcggccaccacgccttcagcgactac

SEQ ID NO: 9778 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggccggccaagggtgcgtcctaaccggcgtcggggtcatagcccacgagtgcggccaccacgccttcagcgactac

SEQ ID NO: 9779 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctccctcaccctctctcctacgcttgcctctctactgggcctgccaagggtgcgtcctaaccggcgtctgggtcagagcccacgagtgcggccaccacgccatcagcgactac

SEQ ID NO: 9780 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 9781 - DNA, 348 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatggcctctctactgggcctgccaagggtgcgtcctaaccggggtctgggtcatagcccacgagttcggccaccacgccttcagcgactac

SEQ ID NO: 9782 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcctccctcaccctctctcctaccctggcctctctactgggcctgccaagggtgcgtcctaaccggcgtctgggtcatagcccacgagtgcggccaccacgccttcagcgactac

SEQ ID NO: 9783 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtccccaccactttcttccctctcctccctcaccccctctcctacttctggcctctctactgggcctgccaagggtgcgtcctaaccggcgtctgggtcatagcccacgagtgcggccaccacgccttcagcgactat

SEQ ID NO: 9784 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccactcacttccctctcctccctcaccctctctctactgggcctgccaaggctgcgtcctaacgggcctctgggtcatcgcccacgaatgcggccaccacgccttcagcgactac

SEQ ID NO: 9785 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgttggcctctctactgggcctgccaagggtgcgtcctaaccggcgtctgggtcatagcccacgagtgcggccaccgcgccttcagcgactac

SEQ ID NO: 9786 - DNA, 348 bp, Artificial
  Mutation in BnaC.FAD2.a introduced by TALE nuclease pair BnFAD2_T01
caggatccatgggtgcaggtggaagaatgcaagtctatcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgtgcctgccaagggtgcgtcctaaccggggtctaggtcataacgcgcgagtgctgcctccacgccttgagcaactac

SEQ ID NO: 9787 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcgaagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 9788 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagccaccacccttcactctcggagacctcaagaaagcaatcccacctcactgcttcaaacgctccatccctcgctccttctcctacctcatctgggacatcatcatagcctcctgcttctactacgtcgccaccacttccttccctctcctccctcaccctctctcctacctctctactgggcctgccaagggtgcgtcctaaccggcgtcggggtcatagcccgcgagtgcggccaccacgccttcagcgactac

SEQ ID NO: 9789 - DNA, 331 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgggcctgccaaggctgcgtcctaaccggcgtctgggtcatagcccacgagtgcggccaccacgccttcagcgactac

SEQ ID NO: 9790 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacctctctactgggcctgccaagggtgcgtcctaaccggcgtcggggtcatagcccgcgagtgcggccaccacgccttcagcgactac

SEQ ID NO: 9791 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaacgggcctctgggtcatagcccacgagtgcggccaccacgccttcagcgactac

SEQ ID NO: 9792 - DNA, 338 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggccggccaagggtgcgtcctaaccggcgtcggggtcatagcccacgattgcggccaccacgccatcagcgactac

SEQ ID NO: 9793 - DNA, 323 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgaaaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagggtgcgtcctaaccggcgtctgggtcatagcccacgagtgcggccaccacgccttcagcgactac

SEQ ID NO: 9794 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccacttggcctctctactgggcctgccaagggtgcgtcctaaccggcgtctgggtcatagcccacgagtgcggccaccacgccttcagcgactac

SEQ ID NO: 9795 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaccgcgtcccctgcgagccaccacccttcactctcggcgacctcaagaaagcaatcccaccgcactgtttcaaccgctcgatccctcgctctttctcctacctcatctgggacatcatcatagcctcctgcttctactacgtcgccaccacttacttccctctcctccctcaccctctctcctcctcctctctactgggcctgccaagggtgcgtcctaaccggcgtctaggtcatagcccacgagtgcggccaccacgccttcagcgactac

SEQ ID NO: 9796 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcctctctactgggcctgccaagggtgcgtcctaaccggcgtctgggtcatagcccacgagtgcggccaccacgccatcagcgactac

SEQ ID NO: 9797 - DNA, 356 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctccttctcctcttcgacatcatcatctcctcctcggctcctccctctaccacctctccacagcctacttccctctcctccctcaccctctctcctacttcgcgcctggcctctctactgggcctgccaagggtgcgtcctaaccggcgtctgggtcatagcccacgagtgcggccaccacgccttcagcgactac

SEQ ID NO: 9798 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcggctctctacttggcctgccaagggtgcctcctaaccggcgtctgggtcatagcccacgagtgcggccaccacgccttcagcgactac

SEQ ID NO: 9799 - DNA, 348 bp, Artificial
  Mutation in BnaC.FAD2.a introduced by TALE nuclease pair BnFAD2_T01
cagtatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 9800 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgatacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 9801 - DNA, 340 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccaagggtgcgtcctaacgggcctctgggtcatcgcccacgaatgcggccaccacgccttcagcgactac

SEQ ID NO: 9802 - DNA, 337 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctactgggcctgccaagggtgcgtcctaaccggcgtctgggtcatagcccacgagtgcggccaccacgccttcagcgactac

SEQ ID NO: 9803 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaaccggcgtctgggtcatagcccacgtgtccggccaccacgccatgagcgactac

SEQ ID NO: 9804 - DNA, 326 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctccccctctactgggcctgccaaggctgcgtcctaaccggcgtctgggtcatagcccacgagtgcggccaccacgccttcagcgactac

SEQ ID NO: 9805 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccgcttggcctctctactgggcctgccaagggtgcgtcctaaccggcgtctgggtcatagcccacgagtgcggccaccacgccttcagcgactac

SEQ ID NO: 9806 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacctctctactgggcctgccaaggctgcgtcctaacgggcctctgggtcatagcccacgagtgcggccaccacgccttcagcgactac

SEQ ID NO: 9807 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtccgaaccggcgtcggggtcatagcccacgagtgcggccaccacgccatcagcgactac

SEQ ID NO: 9808 - DNA, 354 bp, Artificial
  Mutation in BnaC.FAD2.a introduced by TALE nuclease pair BnFAD2_T01
caggatccatgggtgcaggtggaagaatgcaagtgtatccaccctccaagaagtctgaaaccgacaccatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgccctggcccctctactgggcctgccaagggtgcgtcctagccggcgtctgggtcatagcccacgagtgcggccacctcgccttcagcgactac

SEQ ID NO: 9809 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgaatgcggccaccacgccttcagcgactac

SEQ ID NO: 9810 - DNA, 347 bp, Artificial
  Mutation in BnaC.FAD2.a introduced by TALE nuclease pair BnFAD2_T01
caggatccatgggtgcaggtggaagaatgcaagtctcccctccacccagctcccccggaaccaacaccctcaaacccgtcccctgcgagccaccaccattcaccctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccacgacgccttcagcgactac

SEQ ID NO: 9811 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccttcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgtctctctactgggactgtcaagggtgcgtcctaaccggcgtctgggtcatagcccacgagtgcggccaccacgccttcagcgactac

SEQ ID NO: 9812 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgatctttctcctacctcatctgggacatcatcatagcctcctgcttctactacgtcgccaccacttacttccctctcctccctcaccctctctcctaccttggcctctctactgggcctgccaagagtgcgtcctaaccggcgtctgggtcatagcccacgagtgcggccaccacgccgtcagcaactac

SEQ ID NO: 9813 - DNA, 352 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggccctctactgggcctgccaaggctgcgtcctaacgggcgtctgggtcatagcccacgagtgcggccaccacgccttcagcgactac

SEQ ID NO: 9814 - DNA, 358 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccccactgtttcaaacgctcgatccctcgctctttctcctacctcatctgggacatcatcatagcctcctgcttctactacgtcgccaccccttacttccctctcctccccccccctctctcctccttcgcctcgcctggcccctctactgggcctgccaagggtgcgtcctaaccggcgtctgggtcatagcccacgagtgcggccaccacgccttcagcgactac

SEQ ID NO: 9815 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatttgggacatcatcatagcctcctgcttctactacgtcgccaccacttacttccctctcctccctcaccctctctcctacttggcctctctactgggcctgccaaggctgcgtcctaacgggcctctgggtcatagcccacgagtgcggccaccacgccttcagcgactac

SEQ ID NO: 9816 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctctactgggcctgccaagggtgcgtcctaaccggcgtctgggtcatggcccacgagtgcggccaccacgccttcagcgactac

SEQ ID NO: 9817 - DNA, 334 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctgccaagggtgcgtcctaaccggcgtctgggtcatagcccacgagtgcggccaccacgccttcagcgactac

SEQ ID NO: 9818 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcataccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 9819 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcaactac

SEQ ID NO: 9820 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcagagaactcaagaaagcaatcccgccgcactgtttcaaacgctcgatccctcgctctttctcctacctcatctgggacatcatcatagcctcctgcttctactacgtcgccaccacttacttctctctcctccctcaccctctctcctactgtagcctctctacagggcctgccaagggtgcgtcctaaccggcgtctgggtcatagcccgcgagtgcggccaccacgccttcagcgactac

SEQ ID NO: 9821 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggccggccaagggtgcgtcctaagcggcgtctgggtcagagcccacgagtgcggccaccacgccttcagcgactac

SEQ ID NO: 9822 - DNA, 349 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctctctactgggcctgccaagggtgcgtcctaaccggcgtctgggtcatagcccacgagtgcggccacctcgccttcagcgactac

SEQ ID NO: 9823 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgtggtggcctctctactgggcctgccaagggtgcgtcctaaccggcgtctgggtcatagcccacgagtgcggccaccacgccttcagcgactac

SEQ ID NO: 9824 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttggcctctctactgggcctgccaagggtgcgtccgaaccggcgtctgggtcatagcccacgagtgcggccaccacgccttcagcgactac

SEQ ID NO: 9825 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactgcctctctactgggcctgccaagggtgcgtcctaaccggcgtctgggtcatagcccacgagggcggccaccacgccttcagcgacta

SEQ ID NO: 9826 - DNA, 338 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaagggtgcgtcctaaccggcgtctgggtcatagcccacgagtgcggccaccacgccttcagcgactac

SEQ ID NO: 9827 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctgctccctcagcctctctactgggcctgccaagggtgcgtcctaacaggcgtctgggtcatagcccacgagtgcggccaccacgccttcagcgactac

SEQ ID NO: 9828 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctgctccctcagcctctctactgggcctgccaagggtgcgtcctaaccggcgtcggggtcatagcccacgagtgcggccaccacgccttcagcgactac

SEQ ID NO: 9829 - DNA, 349 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacatcatctgggacatcatcatagcctcctgcttctactacgtcgccaccacttacttccctctcctcccccaccctctcccttaccttggcccctctactgggcctgccaaggctgcgtcctaacgggcctctgggtcatagcccacgagtgcggccaccacgccatcagcgactac

SEQ ID NO: 9830 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcactctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 9831 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacaccatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 9832 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgtctctctactgggcctgccaagggtgcgtcctaacgggcctctgggtcatcgcccacgaatgcggccaccacgccttcagcgactac

SEQ ID NO: 9833 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaacgggcgtctgggtcatagcccacgagtgcggccaccacgccttcagcgactac

SEQ ID NO: 9834 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctgcctctctactgggcctgccaagggtgcgtcctaactgtcctcggggtcatcgcccacgaatgcggccaccacgccttcagcgactac

SEQ ID NO: 9835 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaagggtgcgtcctaaccggcgtcttggtcatagcccacgagtgcggccaccacgccttcagcgactac

SEQ ID NO: 9836 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctctctctttctcctacctcatctgggacatcatcatagcctcctgcttctactacgtcgccaccacttacttccctctcctccctcaccctctctcctacttggcctctctactgggcctgccaagggtgcgtcctaacgggcctctgggtcatcgcccacgaatgcggccaccacgccttcagcgactac

SEQ ID NO: 9837 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgttggcctctctactgggcctgccaagggtgcgtcctaaccggcgtctgggtcatagcccacgagtgcggccaccacgccttcagcgactac

SEQ ID NO: 9838 - DNA, 355 bp, Artificial
  Mutation in BnaC.FAD2.a introduced by TALE nuclease pair BnFAD2_T01
caggatccatgggtgcaggtgggagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 9839 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 9840 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactttcggagaactcaagaaagcaatcccaccgacctgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgcctccagcgactcc

SEQ ID NO: 9841 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccccacttggcctctctactgggcctgccaagggtgcgtcctaaccggcgtctgggtcatagcccacgagtgcggccaccacgccttcagcgactac

SEQ ID NO: 9842 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcgggcctctctactgggcctgccaagggtgcgtcctaaccggcgtctgggtcatagcccacgagggcggccacacgccttcagcgactac

SEQ ID NO: 9843 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatcgcccacgagtgcggccaccacgccttcagcgactac

SEQ ID NO: 9844 - DNA, 401 bp, Artificial
  Mutation in BnaC.FAD2.a introduced by TALE nuclease pair BnFAD2_T01
caggatccatgggtgcaggtggaagaatgcaagtgtctcctccctccaagaagactgaaaccgacaccatcaagcgcgtaccctgcgagacatcgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggagacgatggccaccgcctgctggggggtcaagccgtgggcctggcatggcctctctactgggcctgccaagggtgcgtcctaaccggcgtctgggtcatagcccacgagtgcggccaccacgccttcagcgactac

SEQ ID NO: 9845 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccccctcgcggcctctctactgggcctgccaagggtgcgtcctaaccggcgtctgggtcatagcccacgagtgcggccaccacgccttcagcgactac

SEQ ID NO: 9846 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaaggctgcgtcctaacgggcctctgggtcatcgcccacgaatgcggccaccacgccttcagcgactac

SEQ ID NO: 9847 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaacgggcctctgggtcatcgcccacgaatgcggccaccacgccttcagcgactac

SEQ ID NO: 9848 - DNA, 340 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccaagggtgcgtcctcaccggcgtctgggtcatagcccacgagtgcggccaccacgccttcagcgactac

SEQ ID NO: 9849 - DNA, 414 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccggcaaaatcgcgccgaaggatgtcgctgccgactgggcaatggagcgcctgccggcccacctggcctctctactgggcctgccaagggtgcgtcctaaccggcgtctgggtcatagcccacgagtgcggccaccacgccttcagcgactac

SEQ ID NO: 9850 - DNA, 390 bp, Artificial
  Mutation in BnaC.FAD2.a introduced by TALE nuclease pair BnFAD2_T01
caggatccatgggtgcaggtggaagaatgcaagtgtatccaccctcccagaagtctgaaaccgacacaatcaagcgagtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcggtggcaagcacctgctggggtgtcaagccgtgggcggcctctctactgggcctgccaagggtgcttgctagccggcttcggggtcattgcgcgcgagtgcggccaccacgcctttgtcgactac

SEQ ID NO: 9851 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 9852 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagtagtcttaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctactttggcctctctactgggcctgccaagggtgcgtcctaaccggcgtctgggtcatagcccacgagtgcggccaccacgccttcagcgactac

SEQ ID NO: 9853 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccttcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 9854 - DNA, 323 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagggtgcgtccgaaccggcgtcggggtcatagcccacgagtgcggccaccacgccttcagcgactac

SEQ ID NO: 9855 - DNA, 323 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagggtgcgtcctaaccggcgtcggggtcatagcccacgagtgcggccaccacgccttcagcgactac

SEQ ID NO: 9856 - DNA, 348 bp, Artificial
  Mutation in BnaC.FAD2.a introduced by TALE nuclease pair BnFAD2_T01
caggatccatgggtgcaggtggaagaatgcaagtctcacctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttcccgctcctccctcaccctctctcccacttagcctctctactgggcctgccaagggtgcgtcctaacgggcctctgggtcatagcccacgagtgcggcctccacgccttcagcgactac

SEQ ID NO: 9857 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcaggactac

SEQ ID NO: 9858 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagacgtctggaaccgacaccatcaagcgcgtaccctgcgagacaccacccttcactgtcggagaactcaagaaagcaatcccaccgcactgcttcaaacgctcgatccctcgctctttctcctacctcatctgggacatcatcatagcctcctgcttctactacgtcgccaccccttacttccctctcctccctcaccctcccccctacccctctactgggcctgccaagggtgcgtcctaaccggcgtctgggtcatagcccacgagtgcggccaccacgccttcagcgactac

SEQ ID NO: 9859 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcagcctctctactgggcctgccaagggtgcgtcctaaccggcgtctgggtcatagcccacgagtgcggccaccacgccttcagcgactac

SEQ ID NO: 9860 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatcgcccacgaatgcggccaccacgccttcagcgactac

SEQ ID NO: 9861 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgctctgtttcaaacgctcgatccctcgctctttctcctacctcatctgggacatcatcatagcctcctgcttctactacgtcgccaccacttacttccctctcctccctcaccctctctcctacttttggcctctctactgggcctgccaagggttcgtcctaaccggcgtctgggtcatagcccacgagtgcggccaccacgccttcagcgactac

SEQ ID NO: 9862 - DNA, 335 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgtcctaaccggcgtctgggtcatagcccacgagtgcggccaccacgccttcagcgactac

SEQ ID NO: 9863 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggccggccaagggtgcgtcctaaccggcgtctgggtcatagcccacgagtgcggccaccacgccttcagcgactac

SEQ ID NO: 9864 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctacggggcctgccaagggtgcgtcctaaccggcgtctgggtcatagcccacgagtgcggccaccacgccttcagcgactac

SEQ ID NO: 9865 - DNA, 345 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgcaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 9866 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccttcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcagagcccacgagtgcggccaccacgccttcagcgactac

SEQ ID NO: 9867 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactatttcaaacgctcgatccctcgctctttctcctacctcatctgggacatcatcatagcctcctgcttctactacgtcgccaccacttacttccctctcctccctcaccatctctcctacttcgtggtggcctctctactgggcctgccaagggtgcgtcctaaccggcgtctgggtcatagcccacgagtgcggccaccacgccttcagcaactac

SEQ ID NO: 9868 - DNA, 349 bp, Artificial
  Mutation in BnaC.FAD2.a introduced by TALE nuclease pair BnFAD2_T01
caggatccatgggtgcaggtggaagaatgcaagtctatcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtcggggtcatagcccacgagtgcggccaccacgccttcagcgactac

SEQ ID NO: 9869 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccaagggtgcgtcctaaccggcgtctgggtcatagcccacgagtgcggccaccacgccatcagcgactac

SEQ ID NO: 9870 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgctggcctctctactgggcctgccaagggtgcgtcctaaccggcgtctgggtcatagcccacgagtgcggccaccacgccttcagcgactac

SEQ ID NO: 9871 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctctctactgggcctgccaagggtgcgtcctaaccggcgtctgggtcatagcccacgagtgcggccaccacgccttcagcgactac

SEQ ID NO: 9872 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 9873 - DNA, 343 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 9874 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctctccctctcccctactttggcctctctactgggcctgccaaggcttcgtcctaacgggcgtctgggtcatagcccgcgagtgcggccaccgcgccttcagctactac

SEQ ID NO: 9875 - DNA, 383 bp, Artificial
  Mutation in BnaC.FAD2.a introduced by TALE nuclease pair BnFAD2_T01
caggatcaatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcagcggctgttgccggtgctgtgccaggcccacggcttctctctactgggcctgccaagggtgcgtcctaaccggcgtctgggtcatagcccacgagtgcggccaccacgccttcagcgactac

SEQ ID NO: 9876 - DNA, 339 bp, Artificial
  Mutation in BnaC.FAD2.a introduced by TALE nuclease pair BnFAD2_T01
caggatccatgggtgcaggtggaagaatgcaagtgtcccctccctccaagaagtctgaaaccgacaccatcaagcgcgtaccctgcgagacaccaccattcactctcggagacctcaagaaagcaatcccacctcactgcttcaaacgctcgatccctcgctctttctcctacctcatctgggacatcatcatagcccctgcttctactacgtcgccaccacttacttccctctcctccctcaccctctctggcctctctactgggcctgccaagggtgcgtcctaaccggcggctgggtcattgcccacgagtgcggccaccacgccttcacgactgc

SEQ ID NO: 9877 - DNA, 347 bp, Artificial
  Mutation in BnaC.FAD2.a introduced by TALE nuclease pair BnFAD2_T01
caggatccatgggagcaggtggaagaatgcaagtgtctcctccctccaagaaggctgaaaccgacaccatcaagcgcgtaccctgcgagacaccgcccttcactgtcgcagaactcaagaaagcaatcccaccgcactgtttcaaacgctcgatccctcgctctttctcctacctcatctgggacatcatcatagcctcctgcttctactacgtcggcaccacttactaccctctcctccctctccctctcgcccactggcctcgctactgggcctgacaagagtgcgtcctaagcggcgtctgggtcatagcccacgaatgcggccaccacgccttcagcgactac

SEQ ID NO: 9878 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgctcctctctactgggcctgccaagggtgcgtcctaaccggcgtctgggtcatagcccacgagtgcggccaccacgccttcagcgactac

SEQ ID NO: 9879 - DNA, 342 bp, Artificial
  Mutation in BnaC.FAD2.a introduced by TALE nuclease pair BnFAD2_T01
caggatccctgggtgcaggtggaagaatgcaagtgtctcctccctccaagaagtctgaaaccgacaccataaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctatcctccctcaccctctctcctactctctactgggcctgccaagggtgcgtcctaaccggcgtctgggtcatagcccacgagtgcggccaccacgccttcagcgactac

SEQ ID NO: 9880 - DNA, 398 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgccaacttctcaagattgcaaaacgtggcggcgtgaccgcagtggaggcagtgcatgcgcctctctactgggcctgccaagggtgcgtcctaaccggcgtctgggtcatagcccaccagtgcggccaccacgccttcagcgactac

SEQ ID NO: 9881 - DNA, 340 bp, Artificial
  Mutation in BnaC.FAD2.a introduced by TALE nuclease pair BnFAD2_T01
caggaccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctctactgggcctgccaagggtgcgtcctaaccggcgtctgggtcatagcccacgagtgcggccaccacgccttcagcgactac

SEQ ID NO: 9882 - DNA, 329 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactgccaagggtgcgtcctaaccggcgtctgggtcatagcccacgagtgcggccaccacgccttcagcgactac

SEQ ID NO: 9883 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcccccctcctctctactgggcctgccaagggtgcgtcctaaccggcgtctgggtcatagcccacgagtgcggccaccacgccttcagcgactac

SEQ ID NO: 9884 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaaccggcgtctgggtcatagcccacgagtgcggccaccacgccttcagcgactac

SEQ ID NO: 9885 - DNA, 342 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccgtctctctactgggcctgccaagggtgcgtcctaacgggcctctgggtcatagcccacgagtgcggccaccacgccttcagcgactac

SEQ ID NO: 9886 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaagggtgcgtcctaaccggcgtctgggtcatagcccacgagtgcggccaccacgccttcagcgactac

SEQ ID NO: 9887 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaacctacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaacgggcctctgggtcatagcccacgagtgcggccaccacgccttcagcgactac

SEQ ID NO: 9888 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccgtcagcgactac

SEQ ID NO: 9889 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgatggcctctctactgggcctgccaagggtgcgtcctaaccggcctctgggtcatagcccacgagtgcggccaccacgccttcagcgactac

SEQ ID NO: 9890 - DNA, 347 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgaatgcggccaccacgccttcagcgactac

SEQ ID NO: 9891 - DNA, 334 bp, Artificial
  Mutation in BnaC.FAD2.a introduced by TALE nuclease pair BnFAD2_T01
caggatccattggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgctgccaagggtgcgtcctaaccggcgtctgggtcatagcccacgattgcggccaccacgccttcagcgactac

SEQ ID NO: 9892 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatcactcgctctttctcctacctcatctgggacatcatcatagcctcctgcttctactacgtcgccaccacttacttccctctcctccctcaccctctctcctactccgctggcctctctactgggcctgccaagggtgcgtcctaaccggcgtctgggtcatagcccacgagtgcggccaccacgccttcagcgactac

SEQ ID NO: 9893 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctggcctctctactgggcctgccaagggtgcgtcctaaccggcgtctgggtcatagcccacgagtgcggccaccacgccttcagcgactac

SEQ ID NO: 9894 - DNA, 332 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcatctgggtcatagcccacgagtgcggccaccacgccttcagcgactac

SEQ ID NO: 9895 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctccatcccacgctccttctcctcttcgacatcatcatagcctcctgcttctactacgtcgccaccacttacttccctctcctccctcaccctctctcccgcctggcctctctactgggcctgccaagggtgcgtcctaaccggcgtctgggtcatagcccacgagtgcggccaccacgccttcagcgactac

SEQ ID NO: 9896 - DNA, 356 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccgcccggcctctctaccgggcctgccaagggtgcgtcctaaccggcgtctgtgtcatagcccacgagtgcggccaccacgccttcagcgactac

SEQ ID NO: 9897 - DNA, 438 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttaatgtttaactttgttttagggcgactgccctgctgcgtaacatcgttgctggacagcatcgatatcgccgatctacgcacgctcgacctggcctctctactgggcctgccaagggtgcgtcctaaccggcgtctgggtcatagcccacgagtgcggccaccacgccgtcagcgactac

SEQ ID NO: 9898 - DNA, 341 bp, Artificial
  Mutation in BnaC.FAD2.a introduced by TALE nuclease pair BnFAD2_T01
caggatccatgggtgcaggtgcaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcacctacttcgcctgggcctgccaagggtgcgtcctaaccggcgtctgggtgatagcccacgagtgcggccaccacgccttcagcgactac

SEQ ID NO: 9899 - DNA, 351 bp, Artificial
  Mutation in BnaC.FAD2.a introduced by TALE nuclease pair BnFAD2_T01
caggatccatgggtgcaggtggaagaatgcaagtgtctcctccctccaacaagcctgaaaccgacaccctcaagcgcgtaccctgcgagacaccgcccttcactgtcggagaactcaagaaagcaatcccacctcactgtttcaaacgctcgatccctcgctccttctcctaccccatctgggacatcatcatagccccctgcttctactacctccccaccactttctcccctctcccccctcaccctccctcctcccgcctggcctctctactgggcctgccaagggtgcgtcctaacgggcctctgggtcatagcccacgagtgcggccaccacgccttcagcgactac

SEQ ID NO: 9900 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacacactcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccacctctctactgcgccggccaatggtgcgtcctaaccggcgtctgggtcatagcccacgagtgcggccaccgcgccatcagcgactac

SEQ ID NO: 9901 - DNA, 349 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacacagcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 9902 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttcgcgcctggcctctctactgggcctgccaagggtgcgtcctaaccggcgtctgggtcatagcccacgagtgcggccaccacgccttcagcgactac

SEQ ID NO: 9903 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcccacttcgcctctctactgggcctgccaagggtgcgtcctaaccggcgtctgggtcatagcccacgagtgcggccaccacgccttcagcgactac

SEQ ID NO: 9904 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctagcctctctactgggcctgccaaggctgcgtcctaacgggcgtctgggtcatagcccacgagtgcggccaccacgccttcagcgactac

SEQ ID NO: 9905 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccttggcctctctactgggcctgccaagggtgcgtcctaaccggcgtctgggtcatagcccacgagtgcggccaccacgccttcagcgactac

SEQ ID NO: 9906 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccacctcgccttcagcgactac

SEQ ID NO: 9907 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgccgcctggcctctctactgggcctgccaagggtgcgtcctaaccggcgtctgggtcatagcccacgagtgcggccaccacgccttcagcgactac

SEQ ID NO: 9908 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggcgaactcaagaaaacaatcccaccgcactgtttcaaacgctctatccctcgctctttctcctacctcatctgggacatcatcatagcctcctgcttctactacgtcgccaccacttacttccctctcctccctcaccctctcgcctacctcgccctctctactgggcctgccaagcgtgcgtcctaaccggcgtctgggtcatagcccacgagtgcggccaccacgccttcagcgactac

SEQ ID NO: 9909 - DNA, 329 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgccaagggtgcgtcctaaccggcctctgggtcatagcccacgagtgcggccaccacgccttcagcgactac

SEQ ID NO: 9910 - DNA, 394 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgggagcggatttgaacgttgtgaagcaacggcccggagggtggcgggcgtctctactgggcctgccaaggctgcgtcctaacgggcctctgggtcatcgcccacgaatgcggccaccacgccttcagcgactac

SEQ ID NO: 9911 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctagcctctctactgggcctgccaagggtgcgtcctacccggcgtctgggtcatagcccacgagtgcggccaccacgccttcagcgactac

SEQ ID NO: 9912 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaagggtgcgtcctaaccgacgtctgggtcatagcccacgagtgcggccaccacgccttcagcgactac

SEQ ID NO: 9913 - DNA, 378 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcatacctcatctgggacatcatcatagcctcctgcttctactacgtcgccaccacttacttccctctcctccctcaccctctctcctacttcgcctccagcgcctgcttgccgccatcgtggctggcgatggccaccacctgctccggggtcaagccgtgagggctgggtcatagcccacgaatgcggccaccacgccttcagcgactac

SEQ ID NO: 9914 - DNA, 395 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcacgcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcatccctcaccctctctcctacttcgccgcaaactcttcctggctagcggtacgcgtattaagtgcgtcctggcctctctactgggcctgccaagggtgcgtcctaaccggcgtctgggtcagagcccacgagtgcggccaccacgccttcagcgactcc

SEQ ID NO: 9915 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactacgctggcctctctactgggcctgccaagggtgcgtcctaaccggcgtctgggtcatagcccacgagtgcggccaccacgcctacagcgactac

SEQ ID NO: 9916 - DNA, 395 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcatccctcaccctctctcctacgtcgccgcaaactcttcctggctagcggtacgcgtattaattgcgtcctggcctctctactgggcctgccaagggtgcgtcctaaccggcgtctgggtcatagcccacgagtgcggccaccacgccttcagcgactac

SEQ ID NO: 9917 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgctgccaagggtgcgtcctaaccggcgtctgggtcatagcccacgagtgcggccaccacgccttcagcgactac

SEQ ID NO: 9918 - DNA, 343 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctaactctctactgggcctgccaagggtgcgtcctaaccggcgtctgggtcatagcccacgagtgcggccaccacgccttcagcgactac

SEQ ID NO: 9919 - DNA, 351 bp, Artificial
  Mutation in BnaC.FAD2.a introduced by TALE nuclease pair BnFAD2_T01
caggatccatgggtgcaggtggaagtatgcaagtgtctcctccctcccagaagtctgaaaccgacaccatccagcgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccgccacttacttccctctcctccctcaccctctctcctacgtcctggcctctctacggcgcctgccaagggtgcgtcctaaccggcgtctgggtgatagcccaccagtgcggccaccacgccttcatcgactac

SEQ ID NO: 9920 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttggcctctctactgggccagccaagggtgcttcctaaccggcgtcggggtcatagcccacgagtgcggccaccacgccttcagcgactac

SEQ ID NO: 9921 - DNA, 342 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctctgcctctctactgggcctgccaagggtgcgtcctaaccggcgtctgggtcatagcccacgagtgcggccaccacgccttcagcgactac

SEQ ID NO: 9922 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacataatcatagcctcctgcttctactacgtcgccaccacttacttccctctcctccctcaccctctctctactgggcctgccaagggtgcgtcctaaccggcgtctgggtcatagcccacgagtgcggccaccacgcctgcagcgactac

SEQ ID NO: 9923 - DNA, 349 bp, Artificial
  Mutation in BnaC.FAD2.a introduced by TALE nuclease pair BnFAD2_T01
caggatccatgggtgcagggtggaagaatgcaagtgtctcctccctccaagaagtctgaaaccgacaccatcaagcgcgtacgctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaacgggcctctgggtcatagcccacgagtgcggccaccacgcctgcagcgactac

SEQ ID NO: 9924 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccatgggtgcgtcctaaccggcgtcggggtcatagcccgcgagtgcggccaccgcgccatcagcgactac

SEQ ID NO: 9925 - DNA, 348 bp, Artificial
  Mutation in BnaC.FAD2.a introduced by TALE nuclease pair BnFAD2_T01
caggatccatgggtgcagggggaagaatgcaagtgtctcctccctccaagaagtctgaaaccgacaccatcaagcgcgtaccctgcgagacaccgcccttcactgtcggagaactcaagaaagcaatcccaccacactatttcaaacattcgatccctccctctttatcctacctcatctgggacatcatcatagcctcctgcttctactacgtcgccgccacttacttacctctcctccctcacccactctcctgcttgacctcactactgagcctgccaagggtgcgtcctaaccggcgtctgggtcagagcccacgagggcggccaccacgccttcagcgactac

SEQ ID NO: 9926 - DNA, 342 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgcctctctactgggcctgccaagggtgcgtcctaaccggcgtctgggtcatagcccacgagtgcggccaccacgccttcagcgactac

SEQ ID NO: 9927 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgacac

SEQ ID NO: 9928 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcggctctcttctgggcctgccaagggtgcgtcctaacgggcctctgggtcatagcccacgagtgcggccaccacgccttcagcgactac

SEQ ID NO: 9929 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactccgcctctctactgggcctgccaaggctgcgtcctaacgggcctctgggtcatagcccacgagtgcggccaccacgccttcagcgactac

SEQ ID NO: 9930 - DNA, 348 bp, Artificial
  Mutation in BnaC.FAD2.a introduced by TALE nuclease pair BnFAD2_T01
caggatccatgggtgcaggtggcagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 9931 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcacgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcctgccaagggtgcgtcctaaccggcgtctgggtcatagcccacgagtgcggccaccacgccttcagcgactac

SEQ ID NO: 9932 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttctggcctctctactgggcctgccaagggtgcgtcctaaccggcgtctgggtcatagcccacgaatgcggccaccacgccttcagcgactac

SEQ ID NO: 9933 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccatctctcctacttcctggcctctctactgggcctgccaagggtgcgtcctaaccggcgtctgggtcatagcccacgagtgcggccaccacgccttcagcgactac

SEQ ID NO: 9934 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccatctctcctacctcctggcctctctactgggcctgccaagggtgcgtcctaaccggcgtctgggtcatagcccacgagtgcggccaccacgccttcagcgactac

SEQ ID NO: 9935 - DNA, 318 bp, Artificial
  Mutation in BnaC.FAD2.a introduced by TALE nuclease pair BnFAD2_T01
caggatccatgggtgcaggtcgaagaatgcaagtgcatcctccctccaagaagactgaaaccgacaccatcaagcgcatacccttcgagacaccgcccttcactgtcggagaactcaagaaagcaatcccaccgcactgtttcaaacgctcgatccctcgctctttctcctacctcatctgggacatcatcatagcctcctgcttctactacggcgccaccactgggctcgcctctctactggtcgtgggaagcgtgcgttctatctgaggtctgggtcatagcccgcttgttgtgcgaccgcgccatgagctactac

SEQ ID NO: 9936 - DNA, 388 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcggtccagcgcctgcttgccaccattattgctggcgatggcccccccctgctgggcctgccaaggctgcgtcctaacgggcctctgggtcatcgcccacgaatgcggccaccacgccttcagcgactac

SEQ ID NO: 9937 - DNA, 346 bp, Artificial
  Mutation in BnaC.FAD2.a introduced by TALE nuclease pair BnFAD2_T01
caggatccatgggagcaggtggaagaatgcaagtggctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacttcatcatagccgcctgcttctactacgtcgccaccacttacttccctctcctccctcaccctctctcctacggcctctctactgggcctgccaagggtgcgtcctaaccggcctctgggtcatagcccacgagtgcggccaccacgccttcagcgactac

SEQ ID NO: 9938 - DNA, 380 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacagtggtccggcgcacgcgctctggaggcctgcctctctactgggcctgccaagggtgcgtcctaaccggcgtctgggtcatagcccacgagtgcggccaccacgcctgcagcgactac

SEQ ID NO: 9939 - DNA, 325 bp, Artificial
  Mutation in BnaC.FAD2.a introduced by TALE nuclease pair BnFAD2_T01
caggatccatgggtgcaggtggcagaatgcaagtgtgtcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctccgccctcaccctctctcctacttggctgcgtcctaaccggcgtctgggtcatagtccacgagtgcggccaccacgccatcagcgactac

SEQ ID NO: 9940 - DNA, 347 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgcaccatcccacgctccttctcctacctcatctgggacatcatcatagcctcctgcttctactacgtcgccaccacttacttccctctcctccctcaccctctctcacactcgcctctctactgggcctgccaagggtgcgtcctaaccggcgtctgggtcatagcccacgagtgcggccaccacgccttcagcgactac

SEQ ID NO: 9941 - DNA, 346 bp, Artificial
  Mutation in BnaC.FAD2.a introduced by TALE nuclease pair BnFAD2_T01
taggatccatgggtgcaggtggaagaatgcaagtgtctcctccctccaagaagtctgaaaccgacaacatcacgcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaaccggcgtctgggtcatagcccacgagtgcggccaccacgccttcagcgactac

SEQ ID NO: 9942 - DNA, 348 bp, Artificial
  Mutation in BnaC.FAD2.a introduced by TALE nuclease pair BnFAD2_T01
caggatccatgggtgcaggtggaagaatgcaagtgtatactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacctggcctctctactgggcctgccaagggtgcgtcctaaccggcgtctgggtcatagcccacgagtgcggccaccacgccttcagcgactac

SEQ ID NO: 9943 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggctgcgtcctaacgggcctctgggtcatcgcccacgaatgcggccaccacgccttcagcgactac

SEQ ID NO: 9944 - DNA, 354 bp, Artificial
  Mutation in BnaC.FAD2.a introduced by TALE nuclease pair BnFAD2_T01
caggatccatgggtgcaggtggaagaatgcaagtgtctcctccctccaggaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggtggcctctctactgggcctgccaagggtgcgtcctaaccggcgtctgggtcatagcccacgagtgcggccaccacgccttcagcgactac

SEQ ID NO: 9945 - DNA, 325 bp, Artificial
  Mutation in BnaC.FAD2.a introduced by TALE nuclease pair BnFAD2_T01
caggatccattggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcgccaagggtgcgtcctaaccggcgtctgggtcatagcccacgagtgcggccaccacgccttcagcgacttac

SEQ ID NO: 9946 - DNA, 358 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctcgcctggcctctctactgggcctgccaagggtgcgtcctaaccggcgtctgggtcatagcccacgagtgcggccaccacgccttcagcgactac

SEQ ID NO: 9947 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaaatctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 9948 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgcctgtcctctctactgggcctgccaagggtgcgtcctaaccggcgtctgggtcatagcccacgagtgcggccaccacgccttcagcgactac

SEQ ID NO: 9949 - DNA, 346 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaaggctgcgtcctaacgggcctctgggtcatagcccacgagtgcggccaccacgccttcagcgactac

SEQ ID NO: 9950 - DNA, 340 bp, Artificial
  Mutation in BnaC.FAD2.a introduced by TALE nuclease pair BnFAD2_T01
caggatccatgggtgcagggggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctcccacctactctactgctcctgccaagggtgcgtcctcaccggcgtctgggtcatagcccacgagtgcggccaccacgccttcagcgactcc

SEQ ID NO: 9951 - DNA, 344 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 9952 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgtgtaccctgcgagacaccgcccttcgctgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaacgggcctctgggtcatcgcccacgaatgcggccaccacgccttcagcgactac

SEQ ID NO: 9953 - DNA, 405 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgcccccacttacttccctctcctccctcaccctctcccggatttgtcctcctcaggagagcggtcaccgacaaacaacagataaaacgaaaggcccgcctggcctctctactgcgcctgccaagggtgcgtcctaaccggcgtctgggtcatagcccacgagtgcggccaccacgccttcagcgacctac

SEQ ID NO: 9954 - DNA, 343 bp, Artificial
  Mutation in BnaC.FAD2.a introduced by TALE nuclease pair BnFAD2_T01
caggatccatgggtgcaggtggaagaatgcaagtatctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctcccctacttctctactgggcctgccaagggtgcgtcctaaccggcgtctgggtcatagcccacgagtgcggccaccacgccttcagcgactac

SEQ ID NO: 9955 - DNA, 277 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctatttctcctacctcatctgggacatcatcatagcctcctgcttctactacgtcgccaccacttacttccctctcctccctcaccctctctcctacttcacgccttcagcgactac

SEQ ID NO: 9956 - DNA, 419 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactaagactgggcctttcgttttatctgttgtttgtcggtgaacgctctcctgagtaggacaaatccgctcccttggcttttttactgggcctgccaagggtgcgtcctaaccggcgtctgggtcatagcccacgagtgcggccaccacgccttcagcgactac

SEQ ID NO: 9957 - DNA, 321 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctacccggcgtctgggtcatagcccacgagtgcggccaccacgccttcagcgactac

SEQ ID NO: 9958 - DNA, 403 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcggacacctgtccgcctttctcccttcgggaagcgtggcgctttctcatagctcaggcctctctactgggcctgccaagggtgcgtcctaacgggcctctgggtcatagcccacgagtgcggccaccacgccttcagcgactac

SEQ ID NO: 9959 - DNA, 344 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 9960 - DNA, 344 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 9961 - DNA, 348 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctggcctctctactgggcctgccaagggtgcgtcctaaccggcgtctgggtcatagcccacgagtgcggccaccacgccttcagcgactac

SEQ ID NO: 9962 - DNA, 350 bp, Artificial
  Mutation in BnaC.FAD2.a introduced by TALE nuclease pair BnFAD2_T01
caggatccatgggtgcaggtggaagaatgcaagtgtatactccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 9963 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgacgcctggcctctctactgggcctgccaagggtgcgtcctaaccggcgtctgggtcatagcccacgagtgcggccaccacgccttcagcgactac

SEQ ID NO: 9964 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaattccaccgcactgtttcaaacgctcgatccctcgctctttctcctacctcatctgggacatcatcatagcctcctgcttctactacgtcgccaccacttacttccctctcctccctcaccctctctcctactcgcctctctactgggcctgccaagggtgcgtcctaaccggcgtctgggtcatagcccacgagtgcggccaccacgccttcagcgactac

SEQ ID NO: 9965 - DNA, 351 bp, Artificial
  Mutation in BnaC.FAD2.a introduced by TALE nuclease pair BnFAD2_T01
caggatccatgggtgcaggtggaagaatgcaagtctctcctccctccagctcccccggaaccgacaccatcaagcgcgtaccctgcgagacaccgcccttcactgtcggagaactcaagaaagcaatcccaccgcactgtttcaaacgctcgatccctcgctctttctcctgcctcatctgggacatcatcatagcctcctgcttctactacgtcgccaccacttacttccctctcctccctcaccctctctcctacttcctggcctctctactgggcctgccaagggtgcgtcctaaccggcgtctgggtcatagcccacgagtgcggccaccacgccttcagcgactac

SEQ ID NO: 9966 - DNA, 425 bp, Artificial
  Mutation in BnaC.FAD2.a introduced by TALE nuclease pair BnFAD2_T01
caggatccatgggtgcaggtggaagaatgcaagtgcctcctccctccaagaagtctgaaaccgacaccatcaagcgagtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttcccttgcggatttgaactttgtgaagcaacggcccggggggtggcgggccacctcctgctggggggtcaagccgttggcctggcccctctacggggcctgcgaagcctgcgtcgtaacttgcctctgggtcgtcgcccacgaatgcggcggccacgcctgcagcgactac

SEQ ID NO: 9967 - DNA, 348 bp, Artificial
  Mutation in BnaC.FAD2.a introduced by TALE nuclease pair BnFAD2_T01
caggatccatgggtgcaggtggcagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgcccccacttacttccctctcctccctcaccctctctcctacttggcctctctactgggcctgccaaggctgcggcctaacgggcctctgggtcatagcccacgattgcggccaccacgccttcagcgactac

SEQ ID NO: 9968 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaaccggcgtctgggtcatagcccacgagtgcggccaccacgccttcagcgactac

SEQ ID NO: 9969 - DNA, 329 bp, Artificial
  Mutation in BnaC.FAD2.a introduced by TALE nuclease pair BnFAD2_T01
caggatccatgggtgcaggtggaagaatacaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgccaagggtgcgtcctaaccggcgtctgggtcatagcccacgagtgcggccaccacgccttcagcgactac

SEQ ID NO: 9970 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaatggcctctctactgggcctgccaagggtgcgtcctaaccggcgtctgtgtcatagcccacgagtgcggccaccacgccttcagcgactac

SEQ ID NO: 9971 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctctccctctctcctactttggcctctctactgggcctgccaagggtgcgtcctaaccggcgtctgggtcatagcccacgagtgcggccaccacgccttcagcgactac

SEQ ID NO: 9972 - DNA, 329 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgccaagggtgcgtcctaaccggcgtctgggtcatagcccacgagtgcggccaccacgccttcagcgactac

SEQ ID NO: 9973 - DNA, 321 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaaccggcgtctgggtcatagcccacgagtgcggccaccacgccttcagcgactac

SEQ ID NO: 9974 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggggcctctctactgggcctgccaagggtgcgtcctaacgggcctctgggtcatagcccacgagtgcggccaccacgccttcagcgactac

SEQ ID NO: 9975 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgtgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcctgccaagggtgcgtcctaaccggcgtctgggtcatagcccacgagtgcggccaccacgccttcagcgactac

SEQ ID NO: 9976 - DNA, 354 bp, Artificial
  Mutation in BnaC.FAD2.a introduced by TALE nuclease pair BnFAD2_T01
caggatccatgggtgcaggtggcagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccgcctggcctctctactgggcctgccaagggtgcgtcctaaccggcgtctgggtcatagcccacgagtgcggccaccacgccttcagcgactac

SEQ ID NO: 9977 - DNA, 341 bp, Artificial
  Mutation in BnaC.FAD2.a introduced by TALE nuclease pair BnFAD2_T01
caggatccatgggtgcaggtggaagaatgcaagtctctcctccctccagctcccccaggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactctactgggcctgccaagggtgcgtcctaaccggcgtctgggtcatagcccacgagtgcggccaccacgccttcagcgactac

SEQ ID NO: 9978 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatacctcgctctttctcctacctcatctgggacatcatcatagcctcctgcttctactacgtcgccaccacttacttccctctcctccctcaccctctccccctggcctctctactgggcctgccaggggtgcgtcctaaccggcgtctgggtcatagcccacgagtgcggccaccacgccttcagcgactac

SEQ ID NO: 9979 - DNA, 332 bp, Artificial
  Mutation in BnaC.FAD2.a introduced by TALE nuclease pair BnFAD2_T01
caggatccatgggtgcaggtggaagaatgcaagtctctactccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaaccggcgtctgggtcatagcccacgagtgcggccaccacgccttcagcgactac

SEQ ID NO: 9980 - DNA, 321 bp, Artificial
  Mutation in BnaC.FAD2.a introduced by TALE nuclease pair BnFAD2_T01
caggatccatgggtgcaggtggaagaatgcaagtgtatcctccctccaaaaagtctgaaaccgacaccatcaagcgcgtaccctgcgagacaccgcccttcactgtcggagaactcaagaaagcaatcccacctcactgcttcaaacgctccatccctcgctctttctcctacctcatctgggacatcatcatagcctcctgcttctactacgtcgccaccacttacttccctctcctccctcaccctctctcaagggtgcgtcctaaccggcgtctgggtcatagcccacgagtgcggccaccacgccttcagcgactac

SEQ ID NO: 9981 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 9982 - DNA, 347 bp, Artificial
  Mutation in BnaC.FAD2.a introduced by TALE nuclease pair BnFAD2_T01
caggatccatgggtgcaggtggaagaatgcaagtgtctactccctcaaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaacgggcctctggggcatagcccacgagtgcggccaccacgccttcagcgactac

SEQ ID NO: 9983 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtcttggtcatagcccacgagtgcggccaccacgccttcagcgactac

SEQ ID NO: 9984 - DNA, 352 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcccctccctcaccatctcccctacttcgcgggcccctctaccgggcctgccaagggggcgtcctaaccggcgtcggggacatagcccacgagtgcggccaccacgccttcagcgactac

SEQ ID NO: 9985 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgtgtcctaaccggcgtctgggtcatagcccacgagtgcggccaccacgccttcagcgactac

SEQ ID NO: 9986 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaaccggcgtctgggtcatagcccacgagtccggccaccacgccttcagcgactac

SEQ ID NO: 9987 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctgacccctctactgggcctgccaaggctgcgtcctaacgggcctctgggtcatagcccacgagtgcggccaccacgccttcagcgactac

SEQ ID NO: 9988 - DNA, 277 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacgccagcaacgactac

SEQ ID NO: 9989 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaagggtgcgtcctaaccggcgtctgggtcatagcccacgagtgcggccaccacgcctgcagcgactac

SEQ ID NO: 9990 - DNA, 349 bp, Artificial
  Mutation in BnaC.FAD2.a introduced by TALE nuclease pair BnFAD2_T01
caggatccatgggtgcaggtggcagaatgcaagtgtctactccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 9991 - DNA, 335 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccctacggggcctgccaagcgtgcgtcctaacgggccgctgggtcatcgcccacgaatgcggccaccacgccttcagcgactac

SEQ ID NO: 9992 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 9993 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaaggctgcgtcctaacgggcctctgggtcatcgcccacgaatgcggccaccacgccttcagcgactac

SEQ ID NO: 9994 - DNA, 342 bp, Artificial
  Mutation in BnaC.FAD2.a introduced by TALE nuclease pair BnFAD2_T01
caggatccatgggtgcaggtggaagaatgcaagtgtatcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcgcctggcctctctactgggcctgccaagggtgcgtcctaaccggcgtctgggtcatagcccacgagtgcggccaccacgcctgcagcgactac

SEQ ID NO: 9995 - DNA, 355 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctacggggcctgccaagggtgcgtcctaacgggcctctgggtcatagcccacgagtgcggccaccacgccttcagcgactac

SEQ ID NO: 9996 - DNA, 349 bp, Artificial
  Mutation in BnaC.FAD2.a introduced by TALE nuclease pair BnFAD2_T01
caggatccatgggtgcaggtggaagaatgcaagtgtctcctccctcaaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttaccccggcccctctactgggcctgccaaggctgcgtcctaacgggcctctgggtcatcgcccacgaatgcggccaccacgccttcagcgactac

SEQ ID NO: 9997 - DNA, 348 bp, Artificial
  Mutation in BnaC.FAD2.a introduced by TALE nuclease pair BnFAD2_T01
caggatccatgggtgcaggtggcagaatgcaagtgtctcatccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 9998 - DNA, 344 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcttggcctctctactgggcctgccaagggtgcgtcctaaccggcgtctgggtcatagcccacgagtgcggccaccacgccttcagcgactac

SEQ ID NO: 9999 - DNA, 348 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactcggcctgccaagggtgcgtcctaaccggcgtctgggtcatagcccacgagtgcggccaccacgccttcagcgactac

SEQ ID NO: 10000 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaactctctactgggcctgccaagggtgcgtcctaaccggcgtctgggtcatagcccacgagtgcggccaccacgccttcagcgactac

SEQ ID NO: 10001 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctaaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcttacttccctctcctccctcaccctctctcctacttcgtggtggcctctctactgggcctgccaagggtgcgtcctaaccggcgtctgggtcatagcccacgagtgcggccaccacgcctccagcgactac

SEQ ID NO: 10002 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgcctgcagcgactac

SEQ ID NO: 10003 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccataagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcctctctactgggcctgccaagggtgcgtcctaaccggcgtctgggtcatagcccacgagtgcggccaccacgccttcagcgactac

SEQ ID NO: 10004 - DNA, 348 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 10005 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgcttcaaacgctcgatccctcgctctttctcctacctcatctgggacatcatcatagcctcctgcttctactacgtcgccaccacttacttccctctcctccctcaccctctctcctacttcgcccctggcatctctactgggcctgccaagggtgcgtcctaaccggcgtctgggtcatagcccacgagtgcggccaccacgccttcagcgactac

SEQ ID NO: 10006 - DNA, 324 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcgccaagggtgcgtcctaaccggcgtctgggtcatagcccacgagtgcggccaccacgccttcagcgactac

SEQ ID NO: 10007 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 10008 - DNA, 338 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaagggtgcgtcctaaccggcgtctgggtcatagcccacgagtgcggccaccacgccttcagcgactac

SEQ ID NO: 10009 - DNA, 348 bp, Artificial
  Mutation in BnaC.FAD2.a introduced by TALE nuclease pair BnFAD2_T01
caggatccatgggtgcaggtggaagaatgcaagtgtctcctcactcccagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccgcctggcctctctactgggcctgccaagggtgcgtcctaaccggcgtctgggtcatagcccacgagtgcggccaccacgcctgcagcgactac

SEQ ID NO: 10010 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgtgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 10011 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaaccggcgtctgggtcatagcccacgagtgcggccaccacgccttcagctactac

SEQ ID NO: 10012 - DNA, 350 bp, Artificial
  Mutation in BnaC.FAD2.a introduced by TALE nuclease pair BnFAD2_T01
caggatccatgggcgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctacggggcctgccaagggtgcgtcctaaccggcgtctgggtcatagcccacgagtgcggccaccacgccttcagcgactac

SEQ ID NO: 10013 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctaccgggcctgccaagggtgcgtcctaaccggcgtctgggtcatagcccacgagtgcggccaccacgccctcagcgactac

SEQ ID NO: 10014 - DNA, 349 bp, Artificial
  Mutation in BnaC.FAD2.a introduced by TALE nuclease pair BnFAD2_T01
caggatcatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcgtgccaagggtgcgtcctaaccggcgtctggggcatagcccacgtgtgcttccaccgcgccagcaacgactgc

SEQ ID NO: 10015 - DNA, 345 bp, Artificial
  Mutation in BnaC.FAD2.a introduced by TALE nuclease pair BnFAD2_T01
caggatccatgggtgcaggtggaagaatgcaagtctctactccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaacgggcctctgggtcatagcccacgagtgcggccaccacgccttcagcgactac

SEQ ID NO: 10016 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacgctggcctctctactgggcctgccaagggtgcgtcctaaccggcgtctgggtcatagcccacgagtgaggccaccacgccttcagcgactac

SEQ ID NO: 10017 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaaccggcgtctgggtcatagcccacgagtacggccaccacgcctgcagcgactac

SEQ ID NO: 10018 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctggcctctctactgggcctgccaagggtgcgtcctaacgggcctctgggtcatcgcccacgaatgcggccaccacgccttcagcgactac

SEQ ID NO: 10019 - DNA, 351 bp, Artificial
  Mutation in BnaC.FAD2.a introduced by TALE nuclease pair BnFAD2_T01
caggatccatgggtgcaggtggcagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgccaactacgtggcctctctactgggcctgccaagggggcggcctgaccggcgtcggggtcatagcccgcgagtgcggcctccacgccttcagcgactac

SEQ ID NO: 10020 - DNA, 332 bp, Artificial
  Mutation in BnaC.FAD2.a introduced by TALE nuclease pair BnFAD2_T01
caggatccatgggtgcaggtggcagaatgcaagtgtatactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaaccggcgtctgggtcatagcccacgagtgcggccaccacgccttcagcgactac

SEQ ID NO: 10021 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctctttctcctacctcatctgggacatcatcatagcctcctgcttctactacgtcgccaccacttacttccctctcctccctcaccctctctcctcctttggcctctctactgggcctgccaagggtgcgtcctaacgggcctctgggtcatagcccacgagtgcggccaccacgccttcagcgactac

SEQ ID NO: 10022 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 10023 - DNA, 318 bp, Artificial
  Mutation in BnaC.FAD2.a introduced by TALE nuclease pair BnFAD2_T01
caggatccatgggtgcaggtggcagaatgcaagtgtctactccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccaagggtgcgtcctaaccggcgtctgggtcatagcccacgagtgcggccaccacgccttcagcgactac

SEQ ID NO: 10024 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccgtggcctctctactgggcctgccaaggctgcgtcctaacgggcctctgggtcatagcccacgagtgcggccaccacgccttcagcgactac

SEQ ID NO: 10025 - DNA, 350 bp, Artificial
  Mutation in BnaC.FAD2.a introduced by TALE nuclease pair BnFAD2_T01
gaggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 10026 - DNA, 357 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactatgtcgccaccacttacttccctctcctccctcaccggtttgcgtattgccggtgcctggcctctctactgggcctgccaagggtgcgtcctaaccggcgtctgggtcatagcccacgagtgcggccaccacgccttcagcgactac

SEQ ID NO: 10027 - DNA, 345 bp, Artificial
  Mutation in BnaC.FAD2.a introduced by TALE nuclease pair BnFAD2_T01
caggatccatgggtgcaggtggaagaatgcaagtttatactcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaaccggcgtctgggtcatagcccgcgagtgcggcctccacgcctgcatcgactac

SEQ ID NO: 10028 - DNA, 358 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctccccccgacttcgcctcccctggcctctctactgggcctgccaaggcggcgtcctaacgggcctctgggtcatagcccacgagtgcggccaccacgccttcagcgactac

SEQ ID NO: 10029 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcgcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaagggtgcgtcctaaccggcgtctgggtcatagcccacgagtgcggccaccacgcctgcagcgactac

SEQ ID NO: 10030 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcttggcctctctactgggcctgacaagggtgcgtcctaaccggcgtctgggtcatagcccacgagtgcggccaccacgccttcagcgactac

SEQ ID NO: 10031 - DNA, 312 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctgggtctgccaaggctgcgtcctaacgggcctctgggtcatagcccacgagtgcggccaccacgccttcagcgactac

SEQ ID NO: 10032 - DNA, 386 bp, Artificial
  Mutation in BnaC.FAD2.a introduced by TALE nuclease pair BnFAD2_T01
caggatccatgggtgcaggtggaagaatacaagtgtctcctccctccaagaagtctgaaaccgacaacatcaagcgcgtaccctgcgagacaccgcccttcactgtcggagaactcaagatagcaatcccaccgcactgtttcaaacgctcgatccctcgctctttctcctacctcatctgggacatcatcatagcctcctgcttctactacgtcgccaccacttacttccctctcctccctcaccctctctcctacttggccaccacctgctggggggtcaagccgtgggcctggcacagtctctactgggcctgccaagggtgcgtcctaaccggcgtctgggtcatagcccacgagtgcggccaccacgccttcagcgactac

SEQ ID NO: 10033 - DNA, 345 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctggtacatcatcatagcctcctgcctctaccacgtcccccccacctacttccctctcctccctcaccctctcccccaggcctctctactgggcctgccaagggtgcgtcctaacgggcctctgtgtcatcgcccacgaatgcggccaccacgccttcagcgactac

SEQ ID NO: 10034 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactcggcctgccaagggtgcgtcctaaccggcgtctgggtcatagcccacgagtgcggccaccacgccttcagcgactac

SEQ ID NO: 10035 - DNA, 312 bp, Artificial
  Mutation in BnaC.FAD2.a introduced by TALE nuclease pair BnFAD2_T01
caggatccatgggtgaaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 10036 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtcctaaccggcgtctgggtcatagcccacgagtgcggccaccacgccttcagtgactac

SEQ ID NO: 10037 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctggcctctctactgggcctgccaagggtgcgtcctaaccggcgtctgggtcatagcccacgagtgcggccaccacgccttcagcgactac

SEQ ID NO: 10038 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 10039 - DNA, 346 bp, Artificial
  Mutation in BnaC.FAD2.a introduced by TALE nuclease pair BnFAD2_T01
caggatccatgggtgcaggtggcagaatgcaagtctatactccctcccgctcccccggaaccaacaccatcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctgaccggcttcggtgtcatagcccgcgagtgtggcctccacgcctgcagcgactac

SEQ ID NO: 10040 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgcggtggcctctctactgggcctgccaagggtgcgtcctaaccggcgtctgggtcatagcccacgagtgcggccaccacgccttcagcgactac

SEQ ID NO: 10041 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaaccggcgtctggggcatagcccacgagtgcggccaccacgcctgcagcgactac

SEQ ID NO: 10042 - DNA, 393 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacactgggcctttcgttttatctgttgtttgtcggtgaacgctctccttggcctctctactgggcctgccaagggtgcgtcctaaccggcggctgggtcatagcccacgagtgcggccaccacgccttcagcgactac

SEQ ID NO: 10043 - DNA, 348 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccccctctcctacttggcctctctactgggcctgccaagggtgcgtcctaaccggcgtctgggtcatagcccacgagtgcggccaccacgccttcagcgactac

SEQ ID NO: 10044 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattaactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 10045 - DNA, 277 bp, Artificial
  Mutation in BnaC.FAD2.a introduced by TALE nuclease pair BnFAD2_T01
caggatccatgggtgcaggtggaagaatgcaagtgtctcatccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacgccttcagcgactac

SEQ ID NO: 10046 - DNA, 348 bp, Artificial
  Mutation in BnaC.FAD2.a introduced by TALE nuclease pair BnFAD2_T01
caggatccatgggtgcaggtagaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggccttccaagggtgcgtcctaacgggcctcggggtcatcgcccacgaatgcggccaccacgccttcagcgactac

SEQ ID NO: 10047 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggactgccaagggtgcgtcctaaccggcgtctgggtcatagcccacgagtgcggccaccacgccttcagcgactac

SEQ ID NO: 10048 - DNA, 347 bp, Artificial
  Mutation in BnaC.FAD2.a introduced by TALE nuclease pair BnFAD2_T01
caggatccatgggtgcaggtggcagaatgcaagtgcctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 10049 - DNA, 348 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaacgggcctctgggtcatagcccacgagtgcggccaccacgccttcagcgactac

SEQ ID NO: 10050 - DNA, 349 bp, Artificial
  Mutation in BnaC.FAD2.a introduced by TALE nuclease pair BnFAD2_T01
caggatccatgggtgcaggtggaagaatgcaagtgtctcccccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggcctgccaaggctgcgtcctaacgggcctctgggtcatagcccacgagtgcggccaccacgccttcagcgactac

SEQ ID NO: 10051 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcgcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgcctgcagcgactac

SEQ ID NO: 10052 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctacggggcctgccaagggtgcgtcctaacgggcctctgggtcatcgcccacgaatgcggccaccacgccttcagcgactac

SEQ ID NO: 10053 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtcggggtcatagcccacgagtgcggccaccacgccttcagcgactac

SEQ ID NO: 10054 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctggcctctctactgggcctgccaagggtgcgtcctaaccggcgtctgggtcatagcccacgagtgcggctaccacgccttcagcgactac

SEQ ID NO: 10055 - DNA, 342 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgcctctctactgggcctgccaagggtgcgtcctaaccggcgtctgggtcatagcccacgagtgcggccaccacgccttcagcgactac

SEQ ID NO: 10056 - DNA, 418 bp, Artificial
  Mutation in BnaC.FAD2.a introduced by TALE nuclease pair BnFAD2_T01
caggatccatgggtgcaggtggcagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttggaaacttcggcttcccctggagagagcgagattctccgcgctgtagaagtcaccattgttgtgcacgacggcctctctactgggcctgccaagggtgcgtcctaaccggcggctgggtcatagcccgcgagtgcggcctccacgccttcagcgactac

SEQ ID NO: 10057 - DNA, 343 bp, Artificial
  Mutation in BnaC.FAD2.a introduced by TALE nuclease pair BnFAD2_T01
caggatccatgggtgcaggtggaagaatgcaagtctctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtaatagcccacgagtgcggccaccacgccttcagcgactac

SEQ ID NO: 10058 - DNA, 347 bp, Artificial
  Mutation in BnaC.FAD2.a introduced by TALE nuclease pair BnFAD2_T01
caggatccatgggtgcaggtggaagaatgcaagtgtctcctccctcccagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaatggcctctctactgggcctgccaagggtgcgtcctaaccggcgtctgggtcatagcccacgagtgcggccaccacgcctgcagcgactac

SEQ ID NO: 10059 - DNA, 381 bp, Artificial
  Mutation in BnaC.FAD2.a introduced by TALE nuclease pair BnFAD2_T01
caggatccatgggtgcaggtggaagaatgcaagtgtctactccctcaaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgctcgccgcagccgaccgaccgagcgcaccgtggcccctctactgggcctgccatggctgcttcctaacgggcctctgggtcatcgcccacgaatgcgtcctccacgcctgcaacgactac

SEQ ID NO: 10060 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttggcctctctactgggcctgccaagggtgcgtcctaacgggcctctgggtcatcgcccacgaatgcggccaccacgccttcagcgactac

SEQ ID NO: 10061 - DNA, 401 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctttcctccttcgccataacctgccaggcatcaaactaagcagaaggccatccgtccataggctggcctctctactgggcctgccaagggtgcgtcctaacgggcctctgggtcatagcccacgagtgcggccaccacgccttcagcgactac

SEQ ID NO: 10062 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtccccttcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 10063 - DNA, 346 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagccccctgcttctactacgtcgccaccacttacttccctctcctccctcaccctctctcctacttgcctctctactgggcctgccaagggtgcgtccaacgggcctctgggtcatagcccacgagtgcggccaccacgccttcagcgactac

SEQ ID NO: 10064 - DNA, 347 bp, Artificial
  Mutation in BnaC.FAD2.a introduced by TALE nuclease pair BnFAD2_T01
caggatccatgggtgcaggtggcagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggggcgtcctaaccggcgtcggggtcatagcccacgagtgcggccaccacgccttcagcgactac

SEQ ID NO: 10065 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgcctccctcaccctctctcctaccgcctggcctctctactgggcctgccaagggtgcgtcctaaccggcttctgggtcatagcccacgagtgcggccaccacgccttcatcgactac

SEQ ID NO: 10066 - DNA, 318 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccaagggtgcgtcctaaccggcgtctgggtcatagcccacgagtgcggccaccacgccttcagcgactac

SEQ ID NO: 10067 - DNA, 356 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggggcgtcctaacgggcctctgggtcatcgcccacgaatgcggccaccacgccttcagcgactac

SEQ ID NO: 10068 - DNA, 347 bp, Artificial
  Mutation in BnaC.FAD2.a introduced by TALE nuclease pair BnFAD2_T01
caggatccatgggtgcaggtggcagaatgcaagtctctcctccctccaagaagtctgaaaccgacaccatcaagcgcgtaccctgcgagacaccgcccttcactgtcggagaactcaagaaagcaatcccaccgcactgcttcaaacgctccatccctcgctctttctcctacctcatatgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 10069 - DNA, 413 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacccggcggatttgtcctactcaggagggcgttcaccgacaaacaacagataaaacgaaaggcccagtcggcctctctactgggcctgccaagggtgcgtcctaaccggcgtctgggtcatagccctcgagtgcggccaccacgccttcagcgactac

SEQ ID NO: 10070 - DNA, 345 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaaccggcgtctgggtcatagcccacgagtgcggccaccacgccttcagcgactac

SEQ ID NO: 10071 - DNA, 402 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggatacctgtccgcctttctcccttcgggaagcgtggcgctttctcatagctcaggcctctctactgtgcctgccaagggtgcgtcctaaccggcgtctgggtcatagcccacgagtgcggccaccacgccttcagcgactc

SEQ ID NO: 10072 - DNA, 352 bp, Artificial
  Mutation in BnaC.FAD2.a introduced by TALE nuclease pair BnFAD2_T01
caggatccatgggtgcaggtggcagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccaagggtgcgtcctaaccggcgtctgggtcatagcccacgagtgcggccaccacgccttcagcgactac

SEQ ID NO: 10073 - DNA, 345 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 10074 - DNA, 351 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcacgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccaagggtgcgtcctaaccggcgtctgggtcatagcccacgagtgcggccaccacgccttcagcgactac

SEQ ID NO: 10075 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttctggcctctctactgggcctgccaagggtgcgtcctaacgggcctctgggtcatagcccacgagtgcggccaccacgccttcagcgactac

SEQ ID NO: 10076 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgagtgcggccaccacgccttcagcgactac

SEQ ID NO: 10077 - DNA, 385 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccgtgggcctggccccgcaccggcaacagccgctggaccgtctccagcgcctgcctggcctctctactgggcctgccaagggtgcgtcctaaccggcgtctgggtcatagcccacgagtgcggccaccacgccttcagcgactac

SEQ ID NO: 10078 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactactgggcctgccaagggtgcgtcctaaccggcgtctgggtcatagcccacgagtgcggccaccacgccttcagcgactac

SEQ ID NO: 10079 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtctggcctctctactgggcctgccaagggtgcgtcctaaccggcgtctgtggcatagcccacgagtgcggccaccacgcctgcagcgactac

SEQ ID NO: 10080 - DNA, 348 bp, Artificial
  Mutation in BnaC.FAD2.a introduced by TALE nuclease pair BnFAD2_T01
caggatccatgggtgcaggcggaagaatgcaagtgtctcctcactcccagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcgtcctccacgcctgcagcgactac

SEQ ID NO: 10081 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagggcggccaccacgccttcagcgactac

SEQ ID NO: 10082 - DNA, 349 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 10083 - DNA, 345 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 10084 - DNA, 419 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactaagactgggcctttcgttttatctgttgtttgtcggtgaacgctctcctgagtaggacaaatccgctcccttggcttttttactgggcctgccaagggtgcgtcctaaccggcgtctgggtcatagcccacgagtgcggccaccacgccttcagcgactac

SEQ ID NO: 10085 - DNA, 349 bp, Artificial
  Mutation in BnaC.FAD2.a introduced by TALE nuclease pair BnFAD2_T01
caggatccatgggtgcaggtggcagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcggcctaaccggcgtctgggtcatagcccacgagtgcggccagcacgccttcagcgactac

SEQ ID NO: 10086 - DNA, 353 bp, Artificial
  Mutation in BnaC.FAD2.a introduced by TALE nuclease pair BnFAD2_T01
caggatccatgggtgcaggtggaagaatgcaagtgtctcctccctccaagaagtctgaaacagacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggggggggggggggggggggggggggggggggggggggggggggggggtgggtcatagcccacgagtgcggccaccacgccttcagcgactac

SEQ ID NO: 10087 - DNA, 354 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgccctggcctctctactgggcctgccaagggtgcgtcctaaccggcgtctgggtcatagcccacgagtgcggccaccacgccttcagcgactac

SEQ ID NO: 10088 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatcgcccacgaatgcggccaccacgccttcagcgactac

SEQ ID NO: 10089 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttctggcctctctactgggcctgccaagggtgcgtcctaaccggcgtctgggtcatagcccacgagtgcggccaccacgccttcagcgactac

SEQ ID NO: 10090 - DNA, 347 bp, Artificial
  Mutation in BnaC.FAD2.a introduced by TALE nuclease pair BnFAD2_T01
caggatccatgggtgcaggtggcagaatgcaagtgtcttctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcataccctcctgcttctactacgtcgccaccacttacttccctctcctccctcaccctctctcctacttgcctctctactgggcctgccaagggtgcgtcctaaccggcgtctgggtcatagtccacgagtgcggccaccacgccttcagcgactac

SEQ ID NO: 10091 - DNA, 350 bp, Artificial
  Mutation in BnaC.FAD2.a introduced by TALE nuclease pair BnFAD2_T01
caggatccatgggtgcaggcggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaacgggcctctgggtcatagcccacgagggcggccaccacgccttcaacgactac

SEQ ID NO: 10092 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagggcggccaccacgccttcagcgactac

SEQ ID NO: 10093 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcgctgcttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 10094 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggtctctctactgggcctgccaagggtgcgtcctaaccggcgtctgggtcatagcccacgagtgcggccaccacgccttcagcgactac

SEQ ID NO: 10095 - DNA, 277 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactttttcaaacgctcgatccctcgctctttctcctacctcatctgggacatcatcatagcctcctgcttctactacgtcgccaccacttacttccctctcctccctcaccctctctcctacttcacgccttcagcgactac

SEQ ID NO: 10096 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 10097 - DNA, 343 bp, Artificial
  Mutation in BnaC.FAD2.a introduced by TALE nuclease pair BnFAD2_T01
caggatccatgggtgcaggtggaagaatgcaagtgtatactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgcctgcagcgactac

SEQ ID NO: 10098 - DNA, 347 bp, Artificial
  Mutation in BnaC.FAD2.a introduced by TALE nuclease pair BnFAD2_T01
caggatccatgggtgcaggtgggagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 10099 - DNA, 348 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaaggctgcgtcctaacgggcctctgggtcatagcccacgagtgcggccaccacgccttcagcgactac

SEQ ID NO: 10100 - DNA, 344 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactggacctgccaagggtgcgtcctaaccggcgtctgggtcatagcccacgagtgcggccaccacgccttcagcgactac

SEQ ID NO: 10101 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccatcagcgactac

SEQ ID NO: 10102 - DNA, 345 bp, Artificial
  Mutation in BnaC.FAD2.a introduced by TALE nuclease pair BnFAD2_T01
caggatccatgggtgcaggtggcagaatgcaagtgtctcctctctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaacgggcctctgggtcatagcccacgagtgcggccaccacgccttcagcgactac

SEQ ID NO: 10103 - DNA, 347 bp, Artificial
  Mutation in BnaC.FAD2.a introduced by TALE nuclease pair BnFAD2_T01
caggatccatgggtgcaggtggaagaatgcaagtttctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 10104 - DNA, 348 bp, Artificial
  Mutation in BnaC.FAD2.a introduced by TALE nuclease pair BnFAD2_T01
caggatccatgggtgcaggtggcagaatgcaagtctctcatccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 10105 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttctctactgggcctgccaagggtgcgtcctaaccggcgtctgggtcatagcccacgagtgcggccaccacgccttcagcgactac

SEQ ID NO: 10106 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaaccggcgtctgggtcatagcccacgagtgcggccaccacgccttcagcgactac

SEQ ID NO: 10107 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 10108 - DNA, 374 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccaggcttatcttggacaagaagaagatcgctctctactgggcctgccaagggtgcgtcctaacgggcctctgggtcatcgcccacgaatgcggccaccacgccttcagcgactcc

SEQ ID NO: 10109 - DNA, 437 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactaagaaagcaatcccacctcactgcttcaaacgctccatccctcgctctttctcctacctcatctgggacatcatcatagcctcctgcttctactacgtcgccaccacttacttccctctcctccctcaccctctctcctccttcgccagctgggccttgtagttgcccttgaagtggccggacacgaacaggaacttgaactcggtcacgctggaggggtacaccttccacctggcctctctactgggcctgccaagggtgcgtcctaaccggcgtctgggtcatagcccacgagtgcggccaccacgccttcagcgactac

SEQ ID NO: 10110 - DNA, 339 bp, Artificial
  Mutation in BnaC.FAD2.a introduced by TALE nuclease pair BnFAD2_T01
caggatccatgggtgcaggtggaagaatgcaagtgtctaccccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggccttccaagggtgcttcctaaccggcgtctgggtcatagcccacgagtgcggccaccacgccttcagcgactac

SEQ ID NO: 10111 - DNA, 339 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgggtcatagcccacgagtgcggccaccacgccttcagcgactac

SEQ ID NO: 10112 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 10113 - DNA, 343 bp, Artificial
  Mutation in BnaC.FAD2.a introduced by TALE nuclease pair BnFAD2_T01
caggatccatgggtgcaggtggaagaatgcaagtgtctactccctcaaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaactctctactgggcctgccaagggtgcgtcctaaccggcctctgggtcatcgcccacgaatgcggccaccacgccttcagcgactac

SEQ ID NO: 10114 - DNA, 433 bp, Artificial
  Mutation in BnaC.FAD2.a introduced by TALE nuclease pair BnFAD2_T01
caggatccatgggtgcaggtcgcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttaaagtcgcctaaggtcactatcagctagcaaatatttcttgtcaaattgatgagcaatgcttttttataatgccaactttcgcctggcctctctactgggcctgccaaggctgcgtcctaacgggcctctgggtcatagcccacgagtgcggccaccacgccttcagcgactac

SEQ ID NO: 10115 - DNA, 339 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccaagggtgcgtcctaaccggcgtctgggtaatagcccacgagtgcggccaccacgccttcagcgactac

SEQ ID NO: 10116 - DNA, 344 bp, Artificial
  Mutation in BnaC.FAD2.a introduced by TALE nuclease pair BnFAD2_T01
caggatccatggggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgttccctcgctctttctcctacctcatctgggacatcatcatagcctcctgcttctactacgtcgccaccacttacttccctctcctccctccccctctctcctgcctctctactgggcctgccaagggtgcgtcctaacgggcctctgggtcatagcccacgagtgcggccaccacgccttcagcgactac

SEQ ID NO: 10117 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgttggcctctctactgggccggccaagggtgcgtcctaacctgcgtctgggtcatagcccacgagggcggccaccacgccagcatcgactac

SEQ ID NO: 10118 - DNA, 393 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacactgggcctttcgttttatctgttgtttgtcggtgaacgctctccttggcctctctactgggcctgccaagggtgcgtcctaaccggcgtctgggtcatagctcaccagtgcggccaccacgcctgcagcgactac

SEQ ID NO: 10119 - DNA, 348 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctggcctctctactgggcctgccaagggtgcgtcctaaccggcgtctgggtcatagcccaagagtgcggccaccacgccttcagcgactac

SEQ ID NO: 10120 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 10121 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccactcacttccctctcctccctcaccctctctcctacggcctctctactgggcctgccaagggtgcgtcctaaccggcgtctgggtcatagcccacgagtgcggccaccacgccttcagcgactac

SEQ ID NO: 10122 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccatctcctccctcaccctctctcctactctggcctctctactgggcctgccaagggtgcgtcctaaccggcgtctgggtcatagcccacgagggcggccaccacgccttcagcgactac

SEQ ID NO: 10123 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggccatcatcatagcctcctgcttctactacgtcgccaccacttacttccctctcctccctcaccctctctcctacttcgccctggcctctctactgggcctgccaagggtgcgtcctaaccggcgtctgggtcatagcccacgagtgcggccaccacgccttcagcgactac

SEQ ID NO: 10124 - DNA, 350 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccgtctggcctctctactgggccggccaaggctgcgtcctaaccggcgtctgggtcatagcccacgatggcggccaccacgccatcagcgactac

SEQ ID NO: 10125 - DNA, 354 bp, Artificial
  Mutation in BnaC.FAD2.a introduced by TALE nuclease pair BnFAD2_T01
caggatcctgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 10126 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgaatgcggccaccacgccttcagcgactac

SEQ ID NO: 10127 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtcctaaccggcgtctgggtcagagcccacgagtgcggccaccacgcctgcagcgactac

SEQ ID NO: 10128 - DNA, 350 bp, Artificial
  Mutation in BnaC.FAD2.a introduced by TALE nuclease pair BnFAD2_T01
caggatccattggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgaatgcggccaccacgccttcagcgactac

SEQ ID NO: 10129 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctggttcatagcccacgagtgcggccaccacgccttcagcgactac

SEQ ID NO: 10130 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactgtcggctaactcaagaaagcaatcccaccgcactgtttcaaacgctctatccctcgctctttctcctacctcatctggcacatcatcatagcctcctgcttctactacgtcgccaccacttacttccctctcctccctcaccctctctctactgggcctgccaagggtgcgtcctaaccggcgtctgggtcatagcccacgagtgcggccaccacgccttcagtgactac

SEQ ID NO: 10131 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtagccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 10132 - DNA, 348 bp, Artificial
  Mutation in BnaC.FAD2.a introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctccgccctcaccctctctcctacttggcctctctactgggcctgccaagggtgcgtcctaaccggcgtctgggtcatatcccacaagtgcgtcctccacgcctgcagcgactac

SEQ ID NO: 10133 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctctcctacttctggcctctctactgggcctgccaagggtgcgtcctaaccggcgtctgggtcatagcccacgagtgcggccaccacgccttcagcgactac

SEQ ID NO: 10134 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaaggctgcgtcctaacgggcctctgggtcatcgcccacgaatgcggccaccacgccttcagcgactac

SEQ ID NO: 10135 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctccttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 10136 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcacactctctcctacttggcctctctactgggcctgccaagggtgcgtcctaaccggcgtctgggtcatagcccacgagtgcggccaccacgccttcagcgactac

SEQ ID NO: 10137 - DNA, 433 bp, Artificial
  Mutation in BnaC.FAD2.a introduced by TALE nuclease pair BnFAD2_T01
caggatccatgggtgcagctggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtaaagtcgcctaaggtcactatcagctagcaaatatttcttgtcaaagtgatgagcaatgcttttttataatgccaactttcgcctggcctctctactgggcctgccaagggtgcgtcctaaccggcgtctgggtcatagcccacgagtgcggccaccacggcctcagcgactac

SEQ ID NO: 10138 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgctaagggtgcgtcctaaccggcgtctgggtcatagcccacgagtgcggccaccacgccttcagcgactac

SEQ ID NO: 10139 - DNA, 343 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacaagtgcggccaccacgccttcagcgactac

SEQ ID NO: 10140 - DNA, 332 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcagcctctctactgggcctgccaagggtgcgtcctaaccggcgtctgggtcatagcccacgagtgcggccaccacgccttcagcgactcc

SEQ ID NO: 10141 - DNA, 408 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgtgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgagccgaagtttccaaaaggtcgttgatcaaagctcgccgcgttgtttcatcaagccttggcctctctactgggcctgccaagggtgcgtcctaacgggcctctgggtcatcgcccacgaatgcggccaccacgccttcagcgactac

SEQ ID NO: 10142 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccgcgagtgcggccaccacgccttcagcgactac

SEQ ID NO: 10143 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgtctctctactgggcctgccaaggctgcgtcctaacgggcctctgggtcatagcccacgagtgcggccaccacgccttcagcgactac

SEQ ID NO: 10144 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttagcctgccaagggtgcgtcctaaccggcctctgggtcatagcccacgagtgcggccaccacgccttcagcgactac

SEQ ID NO: 10145 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttactgccctctcctccctcaccctctctcctacttcgccctggcctctctactgggcctgccaagggtgcgtcctaaccggcgtctgggtcatagcccacgagtgcggccaccacgccttcagcgactac

SEQ ID NO: 10146 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcccccctcaccctctctcctatggcctctctactgggcctgccaagggtgcgtcctaaccggcgtctgggtcatagcccacgagtgcggccaccacgccttcagcgactac

SEQ ID NO: 10147 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgccgacctctctactgggcctgccaagggtgcgtcctaaccggcgtctgggtcatagcccacgagtgcggccaccacgccttcagcgactac

SEQ ID NO: 10148 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctctactgggcctgccaaggctgcgtcctaaccggcgtctgggtcatagcccacgagtgcggccaccacgccttcagcgactaa

SEQ ID NO: 10149 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaaggctgcgtcctaacgggcctctgggtcatcgcccacgaatgcggccaccacgccttcagcgactac

SEQ ID NO: 10150 - DNA, 417 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgtcaggacatgatcgcagcgttgccagagcgagattctccgcgctgtagaagtcaccattgttgtgctggcctctctactgggcctgccaaggctgcgtcctaacgggcctctgggtcatagcccacgagtgcggccaccacgccttcagcgactac

SEQ ID NO: 10151 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacctctctactgggcctgccaagggtgcgtcctaaccggcgtctgggtcatagcccacgagtgcggccaccacgccttcagcgactac

SEQ ID NO: 10152 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 10153 - DNA, 436 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccctggctggcgatggcccccacctgctccggggtcaagccgtgggcctggcatctctgccaaatagttgggagccaatgagggcaggcctctctactgggcctgccaagggtgcgtcctaaccggcgtctgggtcatagcccacgagtgcggccaccacgccttcagcgactac

SEQ ID NO: 10154 - DNA, 450 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgaaaacggcttgtcccgcgtcatcggcgggggtcataacgtgactcccttaaggcagtgcatgcatggcgcaatgcactgacgggtgccccgctcaactttggcctctctactgggcctgccaagggtgcgtcctaaccggcgtctgggtcatagcccacgagtgcggccaccacgccttcagcgactac

SEQ ID NO: 10155 - DNA, 414 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcaatccctcgctctttctcctacctcatctgggacatcatcatagcctcctgcttctactacgtcgccaccacttacttccctctcctccctcaccctctctcctccttcaccctccctatccccccaaactttttcgctccctactggtctgtggaacgcctgcccgcccacctcccctctctcctgggcctgccaagggtgcgtcctaaccggcgtctgggtcatagcccacgagtgcggccaccacgccttcagcgactac

SEQ ID NO: 10156 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagggcggccaccacgccatcagcgactac

SEQ ID NO: 10157 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaaggctgcgtcctaacgggcctctgggtcatagcccacgagtgcggccaccacgccttcagcgactac

SEQ ID NO: 10158 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcggggcctctctactgggcctgccaagggtgcgtcctaaccggcgtctgggtcatagcccacgagtgcggccaccacgccttcagcgactac

SEQ ID NO: 10159 - DNA, 404 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcggatttgtcctactcaggagagcgttcaccgacaaacaacagataaaacgaaaggcccgcctggcctctctactgggcctgccaagggtgcgtcctaaccggcgtctgggtcatagcccacgagtgcggccaccacgccttcagcgactac

SEQ ID NO: 10160 - DNA, 345 bp, Artificial
  Mutation in BnaC.FAD2.a introduced by TALE nuclease pair BnFAD2_T01
caggatccatgggtgcagggggaagaatgcaagtctctacttcctccagctcccccgaaaccaaaaccctcaaacgcgtcccctgcgagacaccgcccctcactgtcggataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggccgctctactgggcctgccaagggtgcgtccgaacctgcgtctggttcatagccctcgagtgcggccaccactccatcagcgactac

SEQ ID NO: 10161 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttctctactgggcctgccaagggtgcgtcctaaccggcgtctgggtcatagcccacgagtgcggccaccacgcctgcagcgactac

SEQ ID NO: 10162 - DNA, 260 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcccttaccacgccttcagcgactac

SEQ ID NO: 10163 - DNA, 343 bp, Artificial
  Mutation in BnaC.FAD2.a introduced by TALE nuclease pair BnFAD2_T01
caggatccaatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgcctctctactgggcctgccaagggtgcgtcctaacgggcctctgggtcatagcccacgagtgcggccaccacgccttcagcgactac

SEQ ID NO: 10164 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcggctctctactgggcctgccaaggctgcgtcctaacgggcctctgggtcatagcccacgagtgcggccaccacgccttcagcgacta

SEQ ID NO: 10165 - DNA, 345 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcggctctctactgggcctgccaagggtgcgtcctaaccggcgtctgggtcatagcccacgagtgcggccaccacgccttcagcgactac

SEQ ID NO: 10166 - DNA, 321 bp, Artificial
  Mutation in BnaC.FAD2.a introduced by TALE nuclease pair BnFAD2_T01
caggatccatgggtgcaggtggaagaatgcaagtctctcctccctccagctcccccggaaccgaaaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaaccggcgtctgggtcatagcccacgagtgcggccaccacgccttcagcgactac

SEQ ID NO: 10167 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccaacatggcctctcaactgggcctgccaagggtgcgtccgaacgggcctctgggtcatagcccacgagggcggccaccacgccttcagcgactac

SEQ ID NO: 10168 - DNA, 349 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccttggcctctctactgggcctgccaagggtgcgtcctaaccggcgtctgggtcatagcccacgagtgcggccaccacgccttcagcgactac

SEQ ID NO: 10169 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgcttcaaacgctcgatccctcgctctttctcctacctcatctgggacatcatcatatcctcctgcttctactacgtcgccaccacttacttccctctcctcccccaccctctctcctacgcctggcccctctactgggcctgccaagggtgcgtcctaaccggcgtctgggtcatagcccacgagtgcggccaccacgccttcagcgactac

SEQ ID NO: 10170 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctctctactgggcctgccaagggtgcgtcctaaccggcgtctgggtcatagcccacgagggcggccaccacgccttcagcgactac

SEQ ID NO: 10171 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgtcaagggtgcgtcctaaccggcgtctgggtcatagcccacgagtgcggccaccacgccttcagcgactac

SEQ ID NO: 10172 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaacaaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 10173 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcggcctaaccggcgtctgggtcatagcccacgagtgcggccaccacgccttcagcgactac

SEQ ID NO: 10174 - DNA, 344 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaactctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 10175 - DNA, 356 bp, Artificial
  Mutation in BnaC.FAD2.a introduced by TALE nuclease pair BnFAD2_T01
caggatccatgggtgcaggtggcagaatgcaagtcgctcctccctccagctcccccggaaccaacaccctcaaacgcgtcccctgcgagccaccaccattcactctcggagacctcaagaaaccaatcccacctcactgtttcaaacgctcgatccctcgctctttctcctacctcatctgggacatcatcatagcctcctgcttctactacttcgccaccacttacttccctctcctccctcaccctctctcctccttcgccccctggcctctctactgggcctgccaaggttgcgtcctaacgggcctctgggtcatagcccacaagtgcggccaccacgccagcagcgactac

SEQ ID NO: 10176 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacctctggcctctctactgggcctgccaagggtgcgtcctaacgggcctctgggtcatcgcccacgaatgcggccaccacgccttcagcgactac

SEQ ID NO: 10177 - DNA, 338 bp, Artificial
  Mutation in BnaC.FAD2.a introduced by TALE nuclease pair BnFAD2_T01
caggatccatgggtgcaggtggcagaatgcaggtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcctgccaagggtgcgtgctaaccggcgtctgggtcatagcccacgagtgcggccagcacgcctttagcgactac

SEQ ID NO: 10178 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 10179 - DNA, 354 bp, Artificial
  Mutation in BnaC.FAD2.a introduced by TALE nuclease pair BnFAD2_T01
caggaccatgggtgcaggtggaagaatgccagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccaagggtgcgtcctaaccggcgtctgggtcatagcccacgagtgcggccaccacgccttcagcgactac

SEQ ID NO: 10180 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacagcactgtttcaaacgctcgatccctcgctctttctcctacctcatctgggacatcatcatagcctcctgcttctactacgtcgccaccacttacttccctctcctccctcaccctctctcctacctcgaggcctctctactgggcctgccaagggtgcgtcctaaccggcgtctgggtcatagcccacgagtgcggccaccacgccttcagcgactac

SEQ ID NO: 10181 - DNA, 351 bp, Artificial
  Mutation in BnaC.FAD2.a introduced by TALE nuclease pair BnFAD2_T01
caggatccatgggtgcaggtggaagaatgcaagtgactcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaattctcggcctctctactgggcctgccaagggtgcgtcctaaccggcgtctgggtcatagcccacgagtgcggccaccacgccttcagcgactac

SEQ ID NO: 10182 - DNA, 344 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 10183 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaacgggcctctgggtcatagcccacgagtgcggccaccacgccttcagcgactac

SEQ ID NO: 10184 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactgggcctgccaagggtgcgtcctaaccggcgtctgggtcatagcccacgagtgcggccaccacgccttcagcgactac

SEQ ID NO: 10185 - DNA, 354 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctaactgagcctggcctctctactgggcctgccaagggtgcgtcctaaccggcgtctgggtcatagcccacgagtgcggccaccacgccttcagcgactac

SEQ ID NO: 10186 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactcctctctactgggcctgccaagggtgcgtcctaaccggcgtctgggtcatagcccacgagtgcggccaccacgccttcagcgactac

SEQ ID NO: 10187 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaaccggcgtctggttcatagcccacgagtgcggccaccacgccttcagcgactac

SEQ ID NO: 10188 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtccgggtcatagcccacgagtgcggccaccacgccttcagcgactac

SEQ ID NO: 10189 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacactgcccttcactgtcggagaactcaagaaagcaatcccaccgcactgtttcaaacgctcgatccctcgctctttctcctacctcatctgggacatcatcatagcctccttcttctactacgtcgccaccacttacttccctctcctccctcaccctctctcctacttcgccgcctggcctctctacggggcctgccaaggctgcgtcctaacgggcctctgggtcatcgcccacgaatgcggccaccacgccttcagcgactac

SEQ ID NO: 10190 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccggcctctctactgggcctgccaagggtgcgtcctaaccggcgtctgggtcagagcccacgagtgcggccaccacgccttcagcgactac

SEQ ID NO: 10191 - DNA, 350 bp, Artificial
  Mutation in BnaC.FAD2.a introduced by TALE nuclease pair BnFAD2_T01
caggatccatgggtgcaggtgcaagaatgcaagtgtctcctccctccaagaagtctgaaaccgacaccatcaagcgcgtaccctgcgagacaccgcccttcactgtcggagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttctggcctctctacggggcctgccaagggtgcgtcctaaccggcgtctgggtcatagcccacgagtgcggccaccacgccttcagcgactac

SEQ ID NO: 10192 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagatgtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 10193 - DNA, 380 bp, Artificial
  Mutation in BnaC.FAD2.a introduced by TALE nuclease pair BnFAD2_T01
caggatccatgggtgcaggtggaagaatgcaagtgtctcctcactacaagaagtctgaaaccgacaccatcaagcgcgtaccctgcgagacaccgcccttcactgtcggagaactcaagaaagcaatcccaccgcactgtttcaaacgctcgacccctcgctctttctcctacctcatctgggacatcatcatagcctcctgcttctactacgtcgccaccacttacttccctctcctccctcaccctctctcctacttcacagtggtccggcgcacgcgctctggaggcctgcctctctactgggcctgccaagggtgcgtcctaaccggcgtctggttcatagcccacgagtgcggccaccacgccttcagcgactac

SEQ ID NO: 10194 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctactttggcctctctactgggcctgccaagggtgcgtcctaaccggcgtctgggtcatagcccacgagtgcggccaccacgccttcagcgactac

SEQ ID NO: 10195 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatacctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 10196 - DNA, 348 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatggcctctctactgggcctgccaagggtgcttcctaaccggcgtctgggtcatagcccacgagtgcggccaccacgccttcagcgactac

SEQ ID NO: 10197 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccgctctcctacctggcctctctactgggcctgccaagggtgcgtcctaaccggcgtctgggtcatagcgcacgagtgcggccaccacgcctgcagcgactcc

SEQ ID NO: 10198 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctactacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgaatgcggccaccacgccttcagcgactac

SEQ ID NO: 10199 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgcctgcagcgactac

SEQ ID NO: 10200 - DNA, 348 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctggcctctctactgggcctgccaagggtgcgtcctaaccggcgtctgggtcatagcccacgagtgcggccaccacgccttcagcgactac

SEQ ID NO: 10201 - DNA, 333 bp, Artificial
  Mutation in BnaC.FAD2.a introduced by TALE nuclease pair BnFAD2_T01
caggatccatgggtcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaacgggcctctgggtcatagcccacgagtgcggccaccacgccttcagcgactac

SEQ ID NO: 10202 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgagacatcatcatagcctcctgcttctactacgtcgccaccacttacttccctctcctccctcaccctctctcctacttcgtggcctctctactgggcctgccaagggtgcgtcctaaccggcgtctgggtcatagcccacgagtgcggccaccacgccttcagcgactac

SEQ ID NO: 10203 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctctttctcctacctcatctgggacatcatcatagcctcctgcttctactacgtcgccaccacttacttccctctcctccctcaccccctctcccgcctggcctctctactgggcctgccaagggtgcgtcctaaccggcgtctgggtcatagcccacgagtgcggccaccacgccttcagcgactac

SEQ ID NO: 10204 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatccaaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaaccggcgtctgggtcatagcccacgagtgcggccaccacgccttcagcgactac

SEQ ID NO: 10205 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccttctcctccctcaccctctctccgacttcctctctactgggcctgccaagggtgcgtcctaaccggcgtctgggtcatagcccacgagtgcggccaccacgccttcagcgactac

SEQ ID NO: 10206 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtcctaaccggcgtctgggtcatagcccacgagtgcggccaccacgccgtcagcgactac

SEQ ID NO: 10207 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaagggtgcgtcctaaccggcgtctgggtcatagcccacgagtgcggccaccacgcctgcagcgactac

SEQ ID NO: 10208 - DNA, 410 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctagcggatttgtcctactcaggagagcgttcaccgacaaacaacagataaaacgaaaggccctggcccctctactgggcctgccaaggctgcgtcctaacgggcctctgggtcatcgcccacgaatgcggccaccacgccttcagcgactac

SEQ ID NO: 10209 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaacgggcctctgggtcatagcccacgagtgcggccaccacgccttcagcgactac

SEQ ID NO: 10210 - DNA, 351 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgggcctctctactgggcctgccaagggtgcgtcctaaccggcgtctgggtcatagcccacgagtgcggccaccacgccttcagcgactac

SEQ ID NO: 10211 - DNA, 349 bp, Artificial
  Mutation in BnaC.FAD2.a introduced by TALE nuclease pair BnFAD2_T01
caggatccatgggtgcaggtgccagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgctttggcctctctactgggcctgccaagggtgcgtcctgaccggcgtcggggtcatagcccacgagggcggccaccacgccttcagccaccac

SEQ ID NO: 10212 - DNA, 348 bp, Artificial
  Mutation in BnaC.FAD2.a introduced by TALE nuclease pair BnFAD2_T01
caggatccatgggtgcaggtggcagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 10213 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcaacatagcctcctgcttctactacgtcgccaccacttacttccctctcctccctcaccctctctccttggcctctctactgggcctgccaagggtgcgtcctaacgggcctctgggtcatagcccacgagtgcggccaccacgccttcagcgactac

SEQ ID NO: 10214 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctctggcccctctactgggcctgccaagggtgcgtcctaaccggcgtctgggtcatcgcccacgaatgcggccaccacgccttcagcgactac

SEQ ID NO: 10215 - DNA, 349 bp, Artificial
  Mutation in BnaC.FAD2.a introduced by TALE nuclease pair BnFAD2_T01
caggatccatgggtgtaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 10216 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaagggtgcgtcctaaccggcgtctgggtcatagcccacgagtgcggccaccacgccttcagcgactcc

SEQ ID NO: 10217 - DNA, 398 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttgccttggcaacgctgcgatcatgtcctgatacttgacagcgacggtccctggcctctctactgggcctgccaagggtgcgtcctaaccggcgtctgggtcatcgcccacgagtgcggccaccacgccttcagcgactac

SEQ ID NO: 10218 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtcctaaccggcgtctgggtcatagcccacgagtgcggccaccacgccttcagcgactac

SEQ ID NO: 10219 - DNA, 438 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttaatgtttaactttgttttagggcgactgccctgctgcgtaacatcgttgctggacagcatcgatatcgccgatctacgcacgctcgacctggcctctctactgggcctgccaagggtgcgtcctaaccggcgtctgggtcatagcccacgagtgcggccaccacgccttcagcgactac

SEQ ID NO: 10220 - DNA, 350 bp, Artificial
  Mutation in BnaC.FAD2.a introduced by TALE nuclease pair BnFAD2_T01
caggatccatgggtgcaggtggaagaatgcaagtgcctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgcctttagcgactac

SEQ ID NO: 10221 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcgtccaccacgcctgcagcgactac

SEQ ID NO: 10222 - DNA, 356 bp, Artificial
  Mutation in BnaC.FAD2.a introduced by TALE nuclease pair BnFAD2_T01
cagtatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcatcgactac

SEQ ID NO: 10223 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctactgcttctactacgtcgccaccacttacttccctctcctccctcaccctctctccggcctggcctctctactgggcctgccaagggtgggtcctaaccggggtctgggtcatagcccgcgagtgcggccaccacgccgtcagcgactac

SEQ ID NO: 10224 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaaggctgcgtcctaacgggcctctgggtcatcgcccacgaatgcggccaccacgccttcagcgactac

SEQ ID NO: 10225 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacgcctctctactgggcctgccatggctgcgtcctaaccggcgtctgggtcatagcccacgagtgcggccaccacgcctgcagcgactac

SEQ ID NO: 10226 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctccttggcctctctactgggcctgccaagggtgcgtcctaaccggcgtctgggtcatagcccacgagtgcggccaccacgccttcagcgactac

SEQ ID NO: 10227 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 10228 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttcgccctggcctctctactgggcctgccaagggtgcgtcctaaccggcgtctgggtcatagcccacgagtgcggccaccacgccttcagcgactac

SEQ ID NO: 10229 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaacgggcctctgggtcatagcccacgaatgcggccaccacgccttcagcgactac

SEQ ID NO: 10230 - DNA, 401 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccatcggtcccgcgcctgcttgccaccattattgctggcgatggccaccacctgctgggcctctctactgggcctgccaagggtgcgtccgaaccggcgtctgggtcatagcccacgagtgcggccaccacgccttcagcgactac

SEQ ID NO: 10231 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctgctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 10232 - DNA, 356 bp, Artificial
  Mutation in BnaC.FAD2.a introduced by TALE nuclease pair BnFAD2_T01
caggatccatgggtgcaggcggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcacctccctcaccctctctccttctacgaagcctggcctctctactgggcctgacaagggtgcgtcctaaccggcgtctgggtcatagcccacgagagcggccaccacgccttcagcgactac

SEQ ID NO: 10233 - DNA, 277 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcacgccttcagcgactac

SEQ ID NO: 10234 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtatgaaaccgacaccatcaagcgcgtaccccgcgagacaccgcccctcactgtcggagaactcaagaaagcaatcccaccgcactgtttcaaacgctcgatccctcgctctttctcctacctcttctgggacatcatcatagcctcctgcttctactacgtcgccaccacttacttccctctcctccctcaccctctctcccgctttcctctctaccgggcctgccaagggtgcgtcctaaccggcgtctgggtcatagcccacgagtgcggccaccacgccttcagcgactac

SEQ ID NO: 10235 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctacttcgtcgccaccacttacttccctctcctccctcaccctctctcctgcctggcctctctactgggcctgccaagggtgcgtcctaaccggcgtctgggtcatagcccacgagtgcggccaccacgccttcagcgactac

SEQ ID NO: 10236 - DNA, 348 bp, Artificial
  Mutation in BnaC.FAD2.a introduced by TALE nuclease pair BnFAD2_T01
caggatccatgggtgcaggcggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtggcctctctactgggcctgccaagggtgcgtcctaaccggcgtctgggtcatcgcccacgaatgcggccaccacgccttcagcgactac

SEQ ID NO: 10237 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgatacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 10238 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactactgggcctgccaagggtgcgtcctaaccggcctctgggtcatagcccacgagtgcggccaccacgccttcagcgactac

SEQ ID NO: 10239 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagccaacgagtgcggccacctggccttcatcgactaa

SEQ ID NO: 10240 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgtcaagggtgcgtcctaaccggcgtctgggtcatagcccacgagtgcggccaccacgccttcagctactac

SEQ ID NO: 10241 - DNA, 340 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcaccgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccaagggtgcgtcctaaccggcgtctgggtcatagcccacgagtgcggccaccacgccatcagcgactac

SEQ ID NO: 10242 - DNA, 347 bp, Artificial
  Mutation in BnaC.FAD2.a introduced by TALE nuclease pair BnFAD2_T01
caggatccatgggtgcaggtggaagaatgcaagtgtctcctcccttcaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttgcctctctactgggcctgccaaggctgcgtcctaacgggcctctgggtcatagcccacaagtgcggccaccacgccttcagcgactac

SEQ ID NO: 10243 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccagcgtctgggtcatagcccacgagtgcggccaccacgccttcagcgactac

SEQ ID NO: 10244 - DNA, 312 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccatcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 10245 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctggcctctctactgggcctgccaagggtgcgtcctaaccagcgtctgggtcatagcccacgagtgcggccaccacgccttcagcgactac

SEQ ID NO: 10246 - DNA, 350 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcataccctcctgcttctactacgccgccaccacttacttccctctcctccctccccctctctcctacgtctggcctctctactgggcctgccaagggtgcgtcctaaccggcgtctgggtcatagcccacgagtgcggccaccacgccttcagcgactac

SEQ ID NO: 10247 - DNA, 348 bp, Artificial
  Mutation in BnaC.FAD2.a introduced by TALE nuclease pair BnFAD2_T01
caggatccatgggtgcaggtggaagaatgcaagtgtctcctccccccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccccttcgcctctctactgggcctgccaagggtgcgtcctaaccggcgtctgggtcatagcccacgagtgcggccaccacgccttcagcgactac

SEQ ID NO: 10248 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctacggggccggccaagggggcgtcctaacgggccgctgggtcatagcccacgagtgcggccaccacgccttcagcgactac

SEQ ID NO: 10249 - DNA, 350 bp, Artificial
  Mutation in BnaC.FAD2.a introduced by TALE nuclease pair BnFAD2_T01
caggatccatgggtggcaggtggaagaatgcaagtctctcctccctccagctcccccgaaaccaaaaccctcaaacgcgtcccctgcgagacaccaccctttactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcccctctactgggcctgccaaggctgcgtcctaacgggcctctgggtcatagcccacgagtgcggccaccacgccttcagcgactac

SEQ ID NO: 10250 - DNA, 345 bp, Artificial
  Mutation in BnaC.FAD2.a introduced by TALE nuclease pair BnFAD2_T01
caggatccatgggtgcaggtggaagaatgcaagtctctcctccctccaaaaagtctgaaaccgacacaatcaagcgcgtaccctgcgagacaccgcccttcactgtcggagaactcaagaaagcaatcccaccgcactgtttcaaacgctcgatccatcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 10251 - DNA, 345 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctctatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 10252 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagctactac

SEQ ID NO: 10253 - DNA, 337 bp, Artificial
  Mutation in BnaC.FAD2.a introduced by TALE nuclease pair BnFAD2_T01
caggatccatgggtgcaggtggcagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctactgggcctgccaagggtgcgtcctaaccggcgtctgggtcatagcccacgagtgcggccaccacgccttcagcgactac

SEQ ID NO: 10254 - DNA, 347 bp, Artificial
  Mutation in BnaC.FAD2.a introduced by TALE nuclease pair BnFAD2_T01
caggatccatgggtgcaggtggaagaatgcaagtgtctcctcactccaagaagtctgaaaccgacaccatcaagcgcgtaccatgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaaggctgcgtcctaacgggcctctgggtcatagcccacgagtgcggccaccacgcctgcagcgactac

SEQ ID NO: 10255 - DNA, 339 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaaggctgcgtcctaacgggcctctgggtcatcgcccacgaatgcggccaccacgccttcagcgactcc

SEQ ID NO: 10256 - DNA, 318 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctggcacatcatcatagcctcctgcttctactacgtcgccaccacttggcaggcctctctactgggcctgccaagggtgcgtcctaaccggcgtctgggtcatagcccacgagtgcggccaccacgccttcagcgactac

SEQ ID NO: 10257 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggctgcgtcctaacgggcctctgggtcatagcccacgagtgcggccaccacgcctgcagcgactac

SEQ ID NO: 10258 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactaagactgggcctgccaaggctgcgtcctaacgggcctctgggtcatagcccacgagtgcggccaccacgccttcagcgactac

SEQ ID NO: 10259 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcgcctctctactgggcctgccaaggctgcgtcctaacgggcctctgggtcatcgcccacgaatgcggccaccacgcctgcagcgactac

SEQ ID NO: 10260 - DNA, 346 bp, Artificial
  Mutation in BnaC.FAD2.a introduced by TALE nuclease pair BnFAD2_T01
caggatccattggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgagtgcggccaccacgccttcagcgactac

SEQ ID NO: 10261 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaaggctgcgtcctaacgggcctctgggtcatcgcccacgaatgcggccaccacgccttcagcgactac

SEQ ID NO: 10262 - DNA, 378 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctccagcgcctgcttgccgccatcgtggctggcgatggccaccacctgctccggggtcaagccgtgagggctgggtcatagcccacgagtgcggccaccacgccttcagcgactac

SEQ ID NO: 10263 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctactgggcctgccaagggtgcgtcctaaccggcgtctgggtcatagcccacgagtgcggccaccacgccttcagcgactac

SEQ ID NO: 10264 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaaacaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcctctgggtcatagcccacgagtgcggccaccacgccttcagcgactac

SEQ ID NO: 10265 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctcacgggcctctgggtcatcgcccacgagtgcggccaccacgccttcagcgactac

SEQ ID NO: 10266 - DNA, 357 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactatgtcgccaccacttacttccctctcctccctcaccggtttgcgtattgccggtgcctggcctctctactgggcctgccaagggtgcgtcctaaccggcgtctgggtcatagcccacgagtgcggccaccacgccttcagcgactac

SEQ ID NO: 10267 - DNA, 351 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgcccttcagcgactac

SEQ ID NO: 10268 - DNA, 351 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggggcctctctactgggcctgccaagggtgcatcctaaccggcgtctgggtcatagcccacgagtgcggccaccacgccttcagcgactac

SEQ ID NO: 10269 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaaccggcgtctgggtcatcgcccacgaatgcggccaccacgccttcagcgactac

SEQ ID NO: 10270 - DNA, 334 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctgccaagggtgcgtcctaaccggcgtctgggtcatagcccacgagtgcggccaccacgccttcagcgactac

SEQ ID NO: 10271 - DNA, 348 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaacgggcctctgggtcatcgcccacgaatgcggccaccacgccttcagcgactac

SEQ ID NO: 10272 - DNA, 334 bp, Artificial
  Mutation in BnaC.FAD2.a introduced by TALE nuclease pair BnFAD2_T01
caggatccatgggtgcaggtagaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccacgagtgcggccaccacgccttcagcgactac

SEQ ID NO: 10273 - DNA, 349 bp, Artificial
  Mutation in BnaC.FAD2.a introduced by TALE nuclease pair BnFAD2_T01
caggatccatgggtgcaggtggaagaatacaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 10274 - DNA, 343 bp, Artificial
  Mutation in BnaC.FAD2.a introduced by TALE nuclease pair BnFAD2_T01
caggatccatgggtgcagatggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 10275 - DNA, 339 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctctctactgggcccgccaagggtgcgtcctaaccggcgtctgggtcatagcccacgagtgcggccaccacgccttcagcgactac

SEQ ID NO: 10276 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccatcgctctttctcctacctcatctgggacatcatcatagcctcctgcttctactacgtcgccaccacttacttccctctcctccctcaccctctctcctactactgggcctgccaagggtgcgtcctaaccggcgtctgggtcatagcccacgagtgcggccaccacgccttcagcgactac

SEQ ID NO: 10277 - DNA, 385 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccgtgggcctggcacagcaccggcaacagccgctggaccgtctccagcgcctgcctggcctctctactgggcctgccaagggtgcgtcctaaccggcctctgggtcatagcccacgagtgcggccaccacgccttcagcgactac

SEQ ID NO: 10278 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccatctctcctaatggcctctctactgggcctgccaagggtgcgtcctaaccggcgtctgggtcatagcccacgagtgcggccaccacgccttcagcgactac

SEQ ID NO: 10279 - DNA, 349 bp, Artificial
  Mutation in BnaC.FAD2.a introduced by TALE nuclease pair BnFAD2_T01
caggatccatgggtgcaggtggcagaatccaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 10280 - DNA, 351 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccaagggtgcgtcctaacgggcctctgggtcatagcccacgagtgcggccaccacgccttcagcgactac

SEQ ID NO: 10281 - DNA, 337 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctcgcccctctactgggcctgccaaggctgcgtcctaacgggcctctgggtcatcgcccacgaatgcggccaccacgccttcagcgactac

SEQ ID NO: 10282 - DNA, 332 bp, Artificial
  Mutation in BnaC.FAD2.a introduced by TALE nuclease pair BnFAD2_T01
caggatccatgggtgcaggtgacagaatgcaagtctctcctccctccagctcccccggaaccaacaccctcaaacgcgtcccctgcgagacaccaccattcactctcggagacctcaagaaagcaatcccacctcactgcttcaaacgctccatcccacgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 10283 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgtcctaaccggcgtctgggtcatagcccacgagtgtggccaccacgccttcagcgactac

SEQ ID NO: 10284 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctcgttctcctacctcatctgggacatcatcatagcctcctgcttctactacgtcgccaccacttacttccctctcctccctcaccctctctcctacttcgccgcctggccactctactgggcctgccacgggtgcgtcctaaccggcgtctgggtcatagcccacgagtgcggccaccacgccctccgcgactac

SEQ ID NO: 10285 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcgccctctctcctactgtggcctctctactgggcctgccaagggtgcgtcctaaccggcgtctggttcatagcccacgagtgcggccaccacgccttcagcgactac

SEQ ID NO: 10286 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctctttctcctacctcatctgggacatcatcatagcctcctgcttctactacgtcgccaccacttacttccctctcctccctcaccctctctcctacttctctctactgggcctgccaagggtgcgtcctaacgggcctctgggtcatagcccacgagtgcggccaccacgccttcagcgactac

SEQ ID NO: 10287 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaaccggcgtctgggtcatagcccacgagtgcggccaccacgccttcagcgactac

SEQ ID NO: 10288 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaacagacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaagggtgcgtcctaaccggcgtctgggtcatagcccacgagtgcggccaccacgccttcagcgactac

SEQ ID NO: 10289 - DNA, 380 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcacagtggtccggcgcacgcgctctggaggcctgcctctctactgggcctgccaagggtgcgtcctaaccggcgtctgggtcatagcccacgagtgcggccaccacgccttcagcgactac

SEQ ID NO: 10290 - DNA, 318 bp, Artificial
  Mutation in BnaC.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccaagggtgcgtcctaaccggcgtctgggtcatagcccacgagtgcggccaccacgccttcagcgactac

SEQ ID NO: 10291 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcaatccctcgctctttctcctacctcatctgggacatcatcatagcctcctgcttctactacgtcgccaccacttacttccctctcctccctcaccctctctcctacttcgtcgcctggcctctctactgggcctgccaagggtgcgtcctaaccggcgtctgggtcatagcccacgagtgcggccacgacgccttcagcgactac

SEQ ID NO: 10292 - DNA, 394 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcaaactcttcctggctagcggtacgcgtattaattgcgtcctggcctctctactgggcctgccaagggtgcgtcctaaccggcgtctgggtcatagcccacgagtgcggccaccacgccttcagcgctac

SEQ ID NO: 10293 - DNA, 393 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacactgggcctttcgttttatctgttgtgtgtcggtgaacgctctccttggcctctctactgggcctgccaagggtgcggcctaaccggcgtctgggtcatagcccacgagtgcggccaccactccttgagcgactac

SEQ ID NO: 10294 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgacta

SEQ ID NO: 10295 - DNA, 346 bp, Artificial
  Mutation in BnaC.FAD2.a introduced by TALE nuclease pair BnFAD2_T01
caggatccatgggtgcaggtggaagaatgcaagtgtctactccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaaccggcgtctgggtcatagcccacgagtgcggccaccacgccttcagcgactac

SEQ ID NO: 10296 - DNA, 334 bp, Artificial
  Mutation in BnaC.FAD2.a introduced by TALE nuclease pair BnFAD2_T01
caggatccatgggtgcaggtggaagaatgcaagtgtatactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtcggggtcatagcccacgagtgcggccacctcgccttcagcgactac

SEQ ID NO: 10297 - DNA, 408 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcgagccgaagtttccaaaaggtcgttgatcaaagctcgccgcgttgtttcatcaagccttggcctctctactgggcctgccaagggtgcgtcctaaccggcgtctgggtcatagcccacgagtgcggccaccacgccttcagcgactac

SEQ ID NO: 10298 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaaggctgcgtcctaacgggcctctgggtcatagcccacgagtgcggccaccacgccttcagcgactac

SEQ ID NO: 10299 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 10300 - DNA, 321 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaaccggcgtctgggtcatagcccacgagtgcggccaccacgccttcagcgactac

SEQ ID NO: 10301 - DNA, 347 bp, Artificial
  Mutation in BnaC.FAD2.a introduced by TALE nuclease pair BnFAD2_T01
caggatccatgggtgcaggtggcagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 10302 - DNA, 350 bp, Artificial
  Mutation in BnaC.FAD2.a introduced by TALE nuclease pair BnFAD2_T01
caggatccatgggtgcaggtgacagaatgcaagtgtcaactcccacaaagaagtctgaaaccgacaccataaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctggcctctctactgggcctgccaagggtgcgtcctaaccggcgtctgggtcatagcccacgagtgcggccaccacgccttcagcgactac

SEQ ID NO: 10303 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaatatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgactttggcctctctactgggcctgccaagggtgcgtcctaacctgcgtctgggtcatagcccacgagtgcggccaccacgccttcagcgactac

SEQ ID NO: 10304 - DNA, 323 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagggtgcgtcctaaccggcgtctgggtcatagcccacaagtgcggccaccacgccttcagcgactac

SEQ ID NO: 10305 - DNA, 329 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacataatcatagcctcctgcttctactacgtcgccaccacttacttccctctcctccctcaccctctctcctactgccaagggtgcgtcctaacgtgcctctgggtcatcgcccacgaatgcggccaccactccttcagcgactac

SEQ ID NO: 10306 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctcttcgacatcatcatctcctcctcggctcctccctctaccacctctccacagcctacttccctctctcctacttcgcctttggcctctctactgggcctgccaagggtgcgtcctaaccggcgtctgggtcatagcccacgagtgcggccaccacgccttcagcgactac

SEQ ID NO: 10307 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagttcggccaccacgccttcagcgactac

SEQ ID NO: 10308 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggggcgtcctaaccggcgtctgggtcatagcccacgagggcggccaccacgccttcagcgactac

SEQ ID NO: 10309 - DNA, 440 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccccagcggccgttgccaccatgattgcgggcgatgccccccccccgctgcggggtcagcccgtgggatcagggcgagatacctgggccacattgctctccagcgccggcctctctactgggcctgccaagggtgcgtcctaaccggcgtctgggtcatagcccacgagtgcggccaccacgccttcagcgactac

SEQ ID NO: 10310 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctccatccctcgctctttctcctacctcatctgggacatcatcatagcctcctgcttctactacgtcgccaccacttacttccctctcctccctcaccctctctcctcctccggcctctctactgggcctgccaagggtgcgtcctaaccggcgtctgggtcatagcccacgagtgcggccaccacgccttcagcgactac

SEQ ID NO: 10311 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcccctccctcaccctctctcctacttcgcctttggcctctctactgggcctgccaagggtgcgtcctaacgggcctctgggtcatagcccacgagtgcggccaccacgccttcagcgactac

SEQ ID NO: 10312 - DNA, 337 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctactgcttctactacgtcgccaccacttacttccctctcctccctcaccctctctcctctactgggcctgccaaggctgcgtcctaacgggcctctgggtcatagcccacgagtgcggccaccacgccttcagcgactac

SEQ ID NO: 10313 - DNA, 346 bp, Artificial
  Mutation in BnaC.FAD2.a introduced by TALE nuclease pair BnFAD2_T01
caggatccatgggtgcaggtggaagaatgcaagtgtctcctccctccagctcccacgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcctctctactgggcctgccaaggctgcgtcctaacgggcctctgggtcatagcccacgagtgcggccaccacgccttcagcgactac

SEQ ID NO: 10314 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcactcaccctctctcctcctttggcctctctactgggcctgccaagggtgcgtcctaaccggcgtctgggtcatagcccacgagtgcggccaccacgccttcagcgaccac

SEQ ID NO: 10315 - DNA, 398 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgccaacttctcaagattgcaaaacgtggcggcgtgaccgcagtggaggcagtgcatgcgcctctctactgggcctgccaagggtgcgtcctaaccggcgtctgggtcatagcccacgaatgcggccaccacgccttcagcgactac

SEQ ID NO: 10316 - DNA, 374 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccaggcttatcttggacaagaagaagatcgctctctactgggcctgccaagggtgcgtcctaacgggcctctgggtcatcgcccacgaatgcggccaccacgccttcagcgactac

SEQ ID NO: 10317 - DNA, 339 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccaagggtgcgtcctaaccggcgtctgggtcatagcccacgagttcggccaccacgccttcagcgactac

SEQ ID NO: 10318 - DNA, 358 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctaacctggcctctctactgggcctgccaagggtgcgtcctaaccggcgtctgggtcatagcccacgagtgcggccaccacgccttcagcgactac

SEQ ID NO: 10319 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccgcccgcctggcctctctactgggcctgccaagggtgcgtcctaaccggcgtctgggtcatagcccacgagtgcggccaccacgccttcagcgactac

SEQ ID NO: 10320 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaacgggcctctgggtcatcgcccacgaacgcggccaccacgccttcagcgactac

SEQ ID NO: 10321 - DNA, 405 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcaatgcactgacgggtgccccgctcaacttgaccccccagcaggtggtggccatcggcctctctactgggcctgccaagggtgcgtcctaacgggcctctgggtcatagcccacgagtgcggccaccacgccttcagcgactac

SEQ ID NO: 10322 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctatcctacttcgcctttggcctctctactgggcctgccaagggtgcgtcctaaccggcgtctgggtcatagcccacgagtgcggccaccacgccttcagcgactac

SEQ ID NO: 10323 - DNA, 347 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttgcctctctcctgggcctgccaagggtgcgtcctaaccggcgtctgggtcatagcccacgagttcggccaccacgccttcagcgactac

SEQ ID NO: 10324 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgaaacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 10325 - DNA, 344 bp, Artificial
  Mutation in BnaC.FAD2.a introduced by TALE nuclease pair BnFAD2_T01
caggatccatgggtgcaggttgaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaagggtgcgtcctaaccggcgtctgggtcatagcccacgagtgcggccaccacgccttcagcgactac

SEQ ID NO: 10326 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctgcctctctactgggcctgccaagggtgcgtcctaaccggcgtctgggtcatagcccacgagtgcggccaccacgccttcagcgactac

SEQ ID NO: 10327 - DNA, 438 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccagctgggccttgtagttgcccttgaagtggccggacacgaacaggaacttgaactcggtcacgctggaggggtacaccttccacctggcctctctactgggcctgccaagggtgcgtcctaacgggcctctgggtcatcgcccacgaatgcggccaccacgccttcagcgactac

SEQ ID NO: 10328 - DNA, 329 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttctgccaagggtgcgtcctaaccggcgtctgggtcatagcccacgagggcggccaccacgccttcagcgactac

SEQ ID NO: 10329 - DNA, 334 bp, Artificial
  Mutation in BnaC.FAD2.a introduced by TALE nuclease pair BnFAD2_T01
caggatccatgggtgcaggtggaagaatgcaagtgtctcctccctcaaagaagtctgaaaccgacaccatcaagcgcgtaccctgcgagacaccgcccttcactgtcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccacgagttcggccaccacgccttcagcgactac

SEQ ID NO: 10330 - DNA, 343 bp, Artificial
  Mutation in BnaC.FAD2.a introduced by TALE nuclease pair BnFAD2_T01
caggatccatgggtgcaggtggaagaatgcaagtgtctccttcctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 10331 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcatccctcaccctctctcctacttctggcctctctactgggcctgccaagggtgcgtcctaaccggcgtctggttcatagcccacgagtgcggccaccacgccttcagcgactac

SEQ ID NO: 10332 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaaggctgcgtcctaacgggcgtctgggtcatagcccacgagtgcggccaccacgccttcagcgactac

SEQ ID NO: 10333 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcgcctggcccctctactgggcctgccaaggctgcgtcctaacgggcctctgggtcatcgcccacgaatgcggccaccacgccttcagcgactac

SEQ ID NO: 10334 - DNA, 424 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctccttctccagcgcctgcttgccgccatcgtggctggcgatggccaccacctgctggggggtcaagccgtgggcctggcatggcctctctactgggcctgccaagggtgcgtcctaaccggcgtctgggtcatagcccacgagtgcggccaccacgccttcagcgactac

SEQ ID NO: 10335 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccaaggctgcgtcctaacgggcctctgggtcatagcccacgagtgcggccaccacgccttcagcgactac

SEQ ID NO: 10336 - DNA, 358 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctaacctggcctctctactgggcctgccaagggtgcgtcctaaccggcgtctgggtcatagcccacgaatgcggccaccacgccttcagcgactac

SEQ ID NO: 10337 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 10338 - DNA, 350 bp, Artificial
  Mutation in BnaC.FAD2.a introduced by TALE nuclease pair BnFAD2_T01
caggatccatgggtgcaggtgtcagaatgcaagtgtcccctccctcaaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctccttctggcctctctactgggcctgccaagggtgcgtcctaaccggcgtctgtctcatagcccacgagttcgggcacctcggcttcagcgactac

SEQ ID NO: 10339 - DNA, 347 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagggcggccaccacgccttcagcgactac

SEQ ID NO: 10340 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttccgcgactac

SEQ ID NO: 10341 - DNA, 473 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccagtctcatattcactcccaatccaaataatctgcaccggatctcgccctatcagccgttcccagctggtgaagtccgagctggaggagaagaataatggtggcaagcaggcgctggagtccctggcctctctactgggcctgccaagggtgcgtcctaaccggcgtctgggtcatagcccacgagtgcggccaccacgccttcagcgactac

SEQ ID NO: 10342 - DNA, 350 bp, Artificial
  Mutation in BnaC.FAD2.a introduced by TALE nuclease pair BnFAD2_T01
caggatccatgggtgcaggtggaagaatgcaagtgtctccaccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcacctacttctggcctctctactgggcctgccaagggtgcgtcctaaccggcgtctgggtcatagcccacgagtgcggccaccacgccttcagcgactac

SEQ ID NO: 10343 - DNA, 350 bp, Artificial
  Mutation in BnaC.FAD2.a introduced by TALE nuclease pair BnFAD2_T01
caggatccatgggtgcaggtggaagaatgcaagtctctcctccctacagctcccccgaaaccaaaaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagggcggccaccacgccttcagcgactac

SEQ ID NO: 10344 - DNA, 353 bp, Artificial
  Mutation in BnaC.FAD2.a introduced by TALE nuclease pair BnFAD2_T01
caggatccagggtgcaggtggaagaatgcaagtgtctcatccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccgcctggcctctctactgggcctgccaagggtgcgtcctaaccggcgtctgggtcatcgcccacgaatgcggccaccacgccttcagcgactac

SEQ ID NO: 10345 - DNA, 380 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcacagtggtccggcgcacgcgctctggaggcctgcctctctactgggcctgccaagggtgcgtcctaaccggcgtctgggtcatagcccacgagtgcggccaccacgccttcagcgactac

SEQ ID NO: 10346 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctgctacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 10347 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatcccacgctccttctcctcttcgacatcatcatctcctcctcggctcctccctctaccacctctccacagcctacttccctctcctccccctccctctcccttacctctactgggcctgccaaggctgcgtcctaacgggcctctgggtcatagcccacgagtgcggccaccacgccttcagcgactac

SEQ ID NO: 10348 - DNA, 356 bp, Artificial
  Mutation in BnaC.FAD2.a introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 10349 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctggcccctctactgggcctgccaaggctgcgtcctaacgggcgtctgggtcatagcccacgagtgcggccaccacgccttcagcgactac

SEQ ID NO: 10350 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgcctgcagcgactac

SEQ ID NO: 10351 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctcctacgtcgccaccacttacttccctctcctccctcaccctctctcccacttggcctctctactgggcctgccaagggtgcgtcctaaccggcgtctggttcatagcccacgagggcggccaccacgccttcagcgactac

SEQ ID NO: 10352 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgctagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggctgcgtcctaacgggcgtctgggtcatagcccacgagtgcggccaccacgccttcagcgactac

SEQ ID NO: 10353 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgggcctctctactgggcctgccaagggtgcgtcctaaccggcgtctgggtcatagcccacgagtgcggccaccacgccttcagcgactac

SEQ ID NO: 10354 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatcccttgctctttctcctacctcatctgggacatcatcatagcctcctgcttctactacgtcgccaccacttacttccctctcctccctcgccctctctcctccttgcctctctactgggcctgccaagggtgcgtcctaaccggcgtctgggtcatagcccacgagtgcggccaccacgccttcagcgactac

SEQ ID NO: 10355 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccacgagtgcggccaccacgccttcagcgactac

SEQ ID NO: 10356 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccaagggtgcgtcctaacgggcctctgggtcatagcccacgagtgcggccaccacgccttcagcgactac

SEQ ID NO: 10357 - DNA, 349 bp, Artificial
  Mutation in BnaC.FAD2.a introduced by TALE nuclease pair BnFAD2_T01
caggatccatgggtgcaggtggaagaatgcaagtctctcctccctccaacaagcctgaaaccgacaccatcaagcgcgtaccctgcgagacaccgcccttcactgtcggagaactcaagaaagcaatcccaccgcactgtttcaaacgctcgctccctcgctctttctcctacctcatctgggacatcatcatagcctcctgcttctactacgtcgccaccacttacttccctctcctccctcaccctctctcctcctttggcccctctactgggcctgccaaggctgcgtcctaacgggcctctgggtcatcgcccacgaatgcggccaccacgccttcagcgactac

SEQ ID NO: 10358 - DNA, 412 bp, Artificial
  Mutation in BnaC.FAD2.a introduced by TALE nuclease pair BnFAD2_T01
caggatccatgggtgcaggtggaagaatgcaagtgtctctccctccaagaagtctgaaaccgacaccatcaagcgcgtaccctgcgagacaccgcccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacccggcggatttgtcctactcaggagagcgttcaccgacaaacaacagataaaacgaaaggcccagtcggcctctctactgggcctgccaagggtgcgccctaaccggcgtctgggtcatagcccacgagtgcggccaccacgccttcagcgactac

SEQ ID NO: 10359 - DNA, 277 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacgccttcagcgactac

SEQ ID NO: 10360 - DNA, 401 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggtccagcgcctgcttgccaccattattgctggcgatggccaccacctgctgggcctctctactgggcctgccaagggtgcgtcctaaccggcgtctgggtcatagcccacgagtgcggccaccacgccttcagcgactac

SEQ ID NO: 10361 - DNA, 348 bp, Artificial
  Mutation in BnaC.FAD2.a introduced by TALE nuclease pair BnFAD2_T01
caggatccatgggtgcaggtggcagattgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcttcctgcttctactacgtcgccaccacttacttccctctcctccctcaccctctctcctacttggcctctctactgggcctgccaagggttcgtcctagccttcgtctaggtcatagcccaccagtgcggccaccacgccttcagcgactac

SEQ ID NO: 10362 - DNA, 349 bp, Artificial
  Mutation in BnaC.FAD2.a introduced by TALE nuclease pair BnFAD2_T01
caggatccatgggtgcaggtggaagaatgcaagtgcctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctacttctactacgtcgccaccacttacttccctctcctccctcaccctctctcctacttctgcctctctactgggcctgccatggctgcgtcctaaccggcgtctgggtcatagcccacgagtgcggccaccacgccttcagcgactac

SEQ ID NO: 10363 - DNA, 312 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 10364 - DNA, 277 bp, Artificial
  Mutation in BnaC.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttcactctcctccctcaccctctctcctacttcacgccttcagcgactac

SEQ ID NO: 10365 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccaagggtgcgtcctaaccggcgtcttggtcatagcccacgagtgcggccaccacgccttcagcgactac

SEQ ID NO: 10366 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccaagagtgcggccaccacgccttcagcgactac

SEQ ID NO: 10367 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacaggcctctctactgggcctgccaagggtgcgtcctaaccggcgtctgggtcatagcccacgagtgcggccaccacgccttcagcgactac

SEQ ID NO: 10368 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaaccggcgtctggttcatagcccacgagtgcggccaccacgccttcagcgactac

SEQ ID NO: 10369 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctctactgggcctgccaaggctgcgtcctaacgggcctctgggtcatcgcccacgaatgcggccaccacgccttcagcgactac

SEQ ID NO: 10370 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagaaaccgcccttcactgtcggagaactcaagaaagcaatcccaccgcactgtttcaaacgctcgatccctcgctctttctcctacctcatctgggacatcatcatagcctcctgcttctactacgtctccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 10371 - DNA, 348 bp, Artificial
  Mutation in BnaC.FAD2.a introduced by TALE nuclease pair BnFAD2_T01
caggatccattggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctacggggcctgccaagggtgcgtcctaaccggcgtctgggtcatagcccacgagtgcggccaccacgccttcagcgactac

SEQ ID NO: 10372 - DNA, 380 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcacggtggtccggcgcacgcgctctggaggcctgcctctctactgggcctgccaagggtgcgtcctaaccggcgtctgggtcatagcccacgagtgcggccaccacgccttcagcgactac

SEQ ID NO: 10373 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccaagggtgcggcctaaccggcgtctgggtcatagcccacgagtgcggccaccacgccttcagcgactac

SEQ ID NO: 10374 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaacgggcctctgggtcatcgcccacgaatgcggccaccacgccttcagcgactac

SEQ ID NO: 10375 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgcctggcctctctactgggcctgccaagggtgcgtcctaaccggcgtctgggtcatagcccacgagtgcggccaccacgccttcagcgactac

SEQ ID NO: 10376 - DNA, 350 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttctggcctctctactgggcctgccaaggctgcgtcctaacgggcctctgggtcatagcccacgagtgcggccaccacgccttcagcgactac

SEQ ID NO: 10377 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttgcctctctactgggcctgccaagggtgcgtcctaacgggcctctgggtcatcgcccacgaatgcggccaccacgccttcagcgactac

SEQ ID NO: 10378 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcggctctctactgggcctgccaagggtgcgtcctaaccggcgtctgggtcatagcccacgagtgcggccaccacgccttcagcgactac

SEQ ID NO: 10379 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactctctactgggcctgccaagggtgcgtcctaaccggcgtctgggtcatagcccacgagtgcggccaccacgccttcagcgactac

SEQ ID NO: 10380 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggctgcgtcctaacgggcctctgggtcatagcccacgaatgcggccaccacgccttcagcgactac

SEQ ID NO: 10381 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccatctcctccctcaccctctctcctacttacctctctgctgggcctgccaagggtgcgtcctaaccggcgtctgggtcatagcccacgagtgcggccaccacgccttcagcgactac

SEQ ID NO: 10382 - DNA, 401 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggtccagcgcctgcttgccaccattattgctggcgatggccaccacctgctgggcctctctactgggcctgccaagggtgcgtcctaaccggcgtctgggtcatagcccacgagtgcggccaccacgccttcagcgactac

SEQ ID NO: 10383 - DNA, 348 bp, Artificial
  Mutation in BnaC.FAD2.a introduced by TALE nuclease pair BnFAD2_T01
caggatctatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 10384 - DNA, 321 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctactgcttctactacgtcgccaccacttacttccctctcctccctcaccctctctcaagggtgcgtcctaaccggcgtctgggtcatagcccacgagtgcggccaccacgccttcagcgactac

SEQ ID NO: 10385 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctctcctctctactgggcctgccaagggtgcgtcctaaccggcgtctgggtcatagcccacgagtgcggccaccacgccttcagcgactac

SEQ ID NO: 10386 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctggcctctctactgggcctgccaaggctgcgtcctaaccggcgtctgggtcatagcccacgagtgcggccaccacgccttcagcgactac

SEQ ID NO: 10387 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccggaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaaccggcgtctgggtcatagcccacgagtgcggccaccacgccttcagcgactac

SEQ ID NO: 10388 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgtcaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 10389 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggaactgccaagggtgcgtcctaacgggcctctgggtcatagcccacgagtgcggccaccacgccttcagcgactac

SEQ ID NO: 10390 - DNA, 403 bp, Artificial
  Mutation in BnaC.FAD2.a introduced by TALE nuclease pair BnFAD2_T01
caggatccatgggtgcaggtggaagaatgcaagtgtatactccctccaagaagtctgaaaccgacaccatcaagcgcgtaccctgcgagacaccgcccttcactgtcggagaactaaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgatacctgtccgcctttctcccttcgggaagcgtggcgctttctcatagctcaggcctctctactgggcctgccaagggtgcggcctaaccgacgtctgggtcatagcccacgaggtcggccaccacgcattcagcgactac

SEQ ID NO: 10391 - DNA, 356 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcatacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 10392 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgggcctctctacggggcctgccaagggtgcgtcctaaccggcgtctggctcatagcccacgagtgcggccaccacgccttcagcgactac

SEQ ID NO: 10393 - DNA, 312 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctcaccctctctcctactttggcctctctactgggcctgccaaggctgcgtcctaacgggcctctgggtcatcgcccacgaatgcggccaccacgccttcagcgactac

SEQ ID NO: 10394 - DNA, 321 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagcgtgcgtcctaaccggcgtctgggtcatagcccacgagtgcggccaccacgccttcagcgactac

SEQ ID NO: 10395 - DNA, 440 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccccagcggctgttgccaccatgattgctggcgctggccaccacctgctggggggtcaagccgtgggatcagggcgagataactgggcaacaatgctctccagcgccggcctctctactgggcctgccaagggtgcgtcctaaccggcgtctgggtcatagcccacgagtgcggccaccacgccttcagcgactac

SEQ ID NO: 10396 - DNA, 350 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccatcgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 10397 - DNA, 331 bp, Artificial
  Mutation in BnaC.FAD2.a introduced by TALE nuclease pair BnFAD2_T01
caggatccatgtgtgcaggtggaagaatgcaagtgtctcctccctccaagaagtctgaaaccgacaccatcaagcgcgtaccctgcgagacaccgcccttcactgtcgggaaactcaagaaagcaatcccaccgcactgtttcaaacgctcgatccctcgctctttctcctacctcatctgggacatcatcatagcctcctgcttctactacgtcgccaccacttacttcctctcctccctcaccctctctcctgggcctgccaagggtgcgtcctaaccggcgtctgggtcatagcccacgagtgcggccaccacgccttcagcgactaa

SEQ ID NO: 10398 - DNA, 385 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccgtgggcctgccacggcaccggcaacagccgctggcccgtctccagcgcctgcctggcctctctactgggcctgccaagggtgcgtcctaaccggcgtctgggtcatagcccacgagtgcggccaccacgccttcagcgactac

SEQ ID NO: 10399 - DNA, 324 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcgccaagggtgcgtcctaaccggcgtctgggtcatagcccacgagtgcggccaccacgccttcagcgactac

SEQ ID NO: 10400 - DNA, 334 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccttcgctctttctcctacctcatctgggacatcatcatagcctcctgcttctactacgtcgccaccacttacttccctctcctccctcaccctctctcctacttcgctgccaagggtgcgtcctaaccggcgtctgggtcatagcccacgagtgcggccaccacgccttcagcgactac

SEQ ID NO: 10401 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccgcctggcctctctactgggcctgccaaggctgcgtcctaacgggcctctgggtcatcgcccacgaatgcggccaccacgccttcagcgactac

SEQ ID NO: 10402 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccgtcagcgactac

SEQ ID NO: 10403 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaaccggcgtctgggtcatagcccacgagtgcggccaccacgccttcagcgactac

SEQ ID NO: 10404 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctactacctcatctgggacatcatcatagcctcctgcttctactacgtcgccaccacttacttccctctcctccctcaccctctctcctactctctactgggcctgccaagggtgcgtcctaaccggcgtctgggtcatagcccacgagtgcggccaccacgccttcagcgactac

SEQ ID NO: 10405 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 10406 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcctggcctctctactgggcctgccaagggtgcgtcctaaccggcgtctgggtcatagcccacgagtgcggccaccacgccttcagcgactac

SEQ ID NO: 10407 - DNA, 378 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccgtctcctccctcaccctctctcctacttcgcctccagcgcctgcttgccgccatcgtggctggcgatggccaccacctgctccggggtcaagccgtgagggctgggtcatagcccacgagtgcggccaccacgccttcagcgactac

SEQ ID NO: 10408 - DNA, 348 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcgaccaccacgccttcagcgactac

SEQ ID NO: 10409 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcctctctactgggcctgccaagggtgcgtcctaaccggcgtctgggtcatagcccacgagtgcggccaccacgccttcagcgactac

SEQ ID NO: 10410 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 10411 - DNA, 343 bp, Artificial
  Mutation in BnaC.FAD2.a introduced by TALE nuclease pair BnFAD2_T01
caggatccatgggtgcaggtggaagattgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 10412 - DNA, 348 bp, Artificial
  Mutation in BnaC.FAD2.a introduced by TALE nuclease pair BnFAD2_T01
caggatccatgggtgcaggtcgaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcgcacgagtgctgccaccacgccttcagcgactac

SEQ ID NO: 10413 - DNA, 351 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccaagggtgcgtcctaaccggcgtctgggtcatagcccacgagtgcggccaccacgccttcagcgactac

SEQ ID NO: 10414 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgcccgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 10415 - DNA, 412 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgctggagacggtccagcggctgttgccggtgctgtgccaggcccacggcttgaccccggagctggcccctctactgggcctgccaaggctgcgtcctaacgggcctctgggtcatcgcccacgaatgcggccaccacgccttcagcgactac

SEQ ID NO: 10416 - DNA, 348 bp, Artificial
  Mutation in BnaC.FAD2.a introduced by TALE nuclease pair BnFAD2_T01
caggatccatgggtgcaggtggaagaatgcaagtgtctcctcccttcaagaagtctgaaaccgacaccatcaagcgcgtaccctgtgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacaagtgcggccaccacgccatcagcgactac

SEQ ID NO: 10417 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaaggctgcgtcctaacgggcctctgggtcatcgcccacgaatgcggccaccacgccttcagcgactac

SEQ ID NO: 10418 - DNA, 348 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaacgggcctctgggtcatcgcccacgaatgcggccaccacgccttcagcgactac

SEQ ID NO: 10419 - DNA, 341 bp, Artificial
  Mutation in BnaC.FAD2.a introduced by TALE nuclease pair BnFAD2_T01
caggatccatgggtgcaggtgcaagaatgcaagtgtctcctccctccaagaagtctgaaaccgacaacatcaagcgcgtaccctgcgagacaccgcccttcactgtcggagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctatctctactgggcctgccaagggtgcgtcctaaccggcgtctgggtcatagcccacgagtgcggccaccacgccttcagcgactac

SEQ ID NO: 10420 - DNA, 358 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctcgcctggcctctctactgggcctgccaagggtgcgtcctaaccggcgtctgggtcatagcccacgagtgcggccaccacgccttcagcgactac

SEQ ID NO: 10421 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgtgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcttctacttcgcctctctactgggcctgccaagggcgcgtcctaaccggcgtctgggtcatagcccacgagtgcggccaccacgccttcagcgactac

SEQ ID NO: 10422 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcatcatctcctcctcggctcctccctctaccacctctccacagcctacttccctctcctccctcaccctctctcctacttcggcctctctactgggcctgccaagggtgcgtcctaaccggcgtctgggtcatagcccacgagtgcggccaccacgccttcagcgactac

SEQ ID NO: 10423 - DNA, 343 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttctctactgggcctgccaagggtgcgtcctaacgggcctctgggtcatcgcccacgaatgcggccaccacgccttcatcgactac

SEQ ID NO: 10424 - DNA, 300 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgctaagggtgcgtcctaaccggcgtctgggtcatagccaacgagtgcggccaccccgccttcagcgactac

SEQ ID NO: 10425 - DNA, 337 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgctagacaccgcccttcactgtcggagaactcaagaaagcaatcccaccgcactgtttcaaacgctcgatccctcgctctttctcctacctcatctggtacatcatcatagcctcctgcttctactacgtcgccaccacttacttccctctcctccctcaccctctctcctctactgggcctgccaagggtgcgtcctaaccggcgtctgggtcatagcccacgagtgcggccaccacgccttcagcgactac

SEQ ID NO: 10426 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttggcctctctactgggcctgccaagggtgcgtcctaaccggcgtctgggtcatcgcccacgaatgcggccaccacgccttcagcgactac

SEQ ID NO: 10427 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagctactac

SEQ ID NO: 10428 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgtcaagggtgcgtcctaaccggcgtctgggtcatagcccacgagtgcggccaccacgccttcagcgactac

SEQ ID NO: 10429 - DNA, 348 bp, Artificial
  Mutation in BnaC.FAD2.a introduced by TALE nuclease pair BnFAD2_T01
caggatccatgggtgcaggtggaagaatgcaagtgtctcctcccttcaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 10430 - DNA, 344 bp, Artificial
  Mutation in BnaC.FAD2.a introduced by TALE nuclease pair BnFAD2_T01
caggatccatgggtgcagggggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaagggtgtgtcctaaccggcgtctgggtcagagcccacgagtgcggccaccacgccatcagcgactac

SEQ ID NO: 10431 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtctctctactgggcctgccaagggtgcgtcctaaccggcgtctgggtcatagcccacgagtgcggccaccacgccttcagcgactac

SEQ ID NO: 10432 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccgccacttacttccctctcctccctcaccctctctcctacttggcctctctactgggcctgccaagggtgcgtcctaaccggcgtctgggtcatagcccacgagtgtggccaccacgccttcagcgactac

SEQ ID NO: 10433 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgtgtcatagcccacgagtgcggccaccacgccttcagcgactac

SEQ ID NO: 10434 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtatgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaaccggcgtctgggtcatagcccacgagtgcggccaccacgccttcagcgactac

SEQ ID NO: 10435 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgctggtctctctactgggcctgccaagggtgcgtcctaaccggcgtctgggtcatagcccacgagtgcggccaccacgccttcagcgactac

SEQ ID NO: 10436 - DNA, 334 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgctgccaagggtgcgtcctaaccggcgtctgggtcatagcccacgagtgcggccaccacgccttcagcgactac

SEQ ID NO: 10437 - DNA, 321 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaaccggcgtctgggtcatagcccacgagtgcggccaccacgccttcagcgactac

SEQ ID NO: 10438 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcccctggcctctctactgggcctgccaagggtgcgtcctaaccggcgtctgggtcatagcccacgagtgcggccaccacgccttcagcgactac

SEQ ID NO: 10439 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccttggcctctctactgggcctgccaagggtgcgtcctaaccggcgtcttggtcatagcccacgagtgcggccaccacgccttcagcgactac

SEQ ID NO: 10440 - DNA, 348 bp, Artificial
  Mutation in BnaC.FAD2.a introduced by TALE nuclease pair BnFAD2_T01
caggatccattggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctggcctctctactgggcctgccaagggtgcgtcctaaccggcgtctgggtcatagcccacgagtgcggccaccacgccttcagcgactac

SEQ ID NO: 10441 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccgattggcctctctactgggcctgccaagggtgcgtcctaaccggcgtctgggtcatagcccacgagtgcggccaccacgccttcagcgactac

SEQ ID NO: 10442 - DNA, 357 bp, Artificial
  Mutation in BnaC.FAD2.a introduced by TALE nuclease pair BnFAD2_T01
caggatccatgggtgcaggtggaagaatgcaagtttctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggtgcctggcctctctactgggcctgccaaggctgcgtcctaacgggcctctgggtcatcgcccacgaatgcggccaccacgccttcagcgactac

SEQ ID NO: 10443 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccaagggtgcgtcctaaccggcgtctgggtcatagcccacgagtgcggccaccacgccttcagcgactac

SEQ ID NO: 10444 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatcccacgctccttctcctacctcatctgggacatcatcatagcctcctgcttctactacgtcgccaccacttacttccctctcctccctcaccctctctcttggcctctctactgggcctgccaaggctgcgtcctaacgggcctctgggtcatcgcccacgaatgcggccaccacgccttcagcgactac

SEQ ID NO: 10445 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttcgcctggcctctctactgggcctgccaagggtgcgtcctaaccggcgtctgggtcatagcccacgagtgcggccaccacgccttcagcgactac

SEQ ID NO: 10446 - DNA, 349 bp, Artificial
  Mutation in BnaC.FAD2.a introduced by TALE nuclease pair BnFAD2_T01
caggatccatgggtgcaggtggaagaattcaagtgtctcctccctccaagaagtctgaaaccgacaccatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggccggccaagggtgcgtcctaaccggcgtctgggtcatagcccacgagtgcggccaccacgccttcagcgactac

SEQ ID NO: 10447 - DNA, 323 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtacactgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccatccactgggcctgccaagggtgcgtcctaaccggcgtctgggtcatagcccacgagtgcggccaccacgccttcagcgactac

SEQ ID NO: 10448 - DNA, 343 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 10449 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 10450 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccgcgagttctgccaccacgccatgagcgactac

SEQ ID NO: 10451 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccgcttggcctctctactgggcctgccaagggtgcgtcctaaccggcgtctgggtcatagcccacgagtgcggccaccacgccttcagcgactac

SEQ ID NO: 10452 - DNA, 351 bp, Artificial
  Mutation in BnaC.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggggcctctctactgggcctgccaagggtgcgtcctaaccggcgtctgggtcatagcccacgagtgcggccaccacgccttcagcgactac

SEQ ID NO: 10453 - DNA, 334 bp, Artificial
  Mutation in BnaC.FAD2.a introduced by TALE nuclease pair BnFAD2_T01
caggatccatgggtgcaggtggaagaacgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccacgagtgcggccaccacgccttcagcgactac

SEQ ID NO: 10454 - DNA, 355 bp, Artificial
  Mutation in BnaC.FAD2.a introduced by TALE nuclease pair BnFAD2_T01
caggatccatgggtgcaggtggaagaatgcaagtgactcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 10455 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 10456 - DNA, 342 bp, Artificial
  Mutation in BnaC.FAD2.a introduced by TALE nuclease pair BnFAD2_T01
caggatccatggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 10457 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcatctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 10458 - DNA, 334 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctccttcgctgccaagggtgcgtcctaaccggcgtctgggtcatagcccacgagtgcggccaccacgccttcagcgactac

SEQ ID NO: 10459 - DNA, 335 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccacctcactgcttcaaacgctccatccctcgctctttctcctgcctcatctgggacatcatcatagcctcctgcttctactacgtcgccaccacttacttccctctcctccctcaccctctctcctactgggcctgccaagggtgcgtcctaaccggcgtctgggtcatagcccacgagtgcggccaccacgccttcagcgactac

SEQ ID NO: 10460 - DNA, 386 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggccaccacctgctggggggtcaagccgtgggcctggcacagtctctactgggcctgccaagggtgcgtcctaaccggcgtctgggtcatagcccacgagtgcggccaccacgccttcagcgactac

SEQ ID NO: 10461 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 10462 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaaccggcgtctgggtcatagcccacgaatgcggccaccacgccttcagcgactac

SEQ ID NO: 10463 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccaaggctgcgtcctaacgggcgtctgggtcatcgcccacgaatgcggccaccacgccttcagcgactac

SEQ ID NO: 10464 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 10465 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 10466 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccctccttcccctctactgggccggccaagggtgcgtcctaaccggcgtctggttcatagcccacgagggcggccaccacgccttcagcgctac

SEQ ID NO: 10467 - DNA, 343 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 10468 - DNA, 374 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccaggcttatcttggacaagaagaagatcgctctctactgggcctgccaagggtgcgtcctaaccggcgtctgggtcatagcccacgagtgcggccaccacgccttcagcgactac

SEQ ID NO: 10469 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctccctcatctgggacatcatcatagcctcctgcttctactacgtcgccaccacttacttccctctcctccctcaccctcgcctggcctctctactgggcctgccaaggctgcgtcctaacgggcctctgggtcatagcccacgagtgcggccaccacgccttcagcgactac

SEQ ID NO: 10470 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcctctgggtcatagcccacgagtgcggccaccacgcctttagcgactac

SEQ ID NO: 10471 - DNA, 398 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttgccttggcaccgctgcgatcatgtcctgatacttgacagcgacggtccctggcctctctactgggcctgccaagggtgcgtcctaacgggcctctgggtcatcgcccacgaatgcggccaccacgccttcagcgactac

SEQ ID NO: 10472 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttgcctctctactgggcctgccaagggtgcgtcctaaccggcgtctgggtcatagcccacgagtgcggccaccacgccttcagcgactac

SEQ ID NO: 10473 - DNA, 337 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctactgggcctgccgagggtgcgtcctaacgggcctctgggtcatcgcccacgaatgcggccaccacgccttcagcgactac

SEQ ID NO: 10474 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctggcacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 10475 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgaaaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctccaccccttacttccctctcctccctcaccctctctcctacgtcactgccaagggtgcgtcctaaccggcgtctgggtcatagcccacgagtgcggccaccacgccttcagcgactac

SEQ ID NO: 10476 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcataggccacgagtgcggccaccacgccttcagcgactac

SEQ ID NO: 10477 - DNA, 343 bp, Artificial
  Mutation in BnaC.FAD2.a introduced by TALE nuclease pair BnFAD2_T01
caggatccatgggtgcaggtggaagaatgcatgtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgcctccacttacttccctctcctccctctccctctcccctactcctctactgggcctgccaagggtgcgtcctaaccggcgtctgggtcatagcccacgagtgcggccaccacgccttcagcgactac

SEQ ID NO: 10478 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcccgcctggcctctctactgggcctgccaagggtgcgtcctaaccggcgtctgggtcatagcccacgagtgcggccaccacgccttcagcgactac

SEQ ID NO: 10479 - DNA, 334 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaaggctgcgtcctaaccggcgtctgggtcatagcccacgagtgcggccaccacgccttcagcgactac

SEQ ID NO: 10480 - DNA, 348 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaacgggcctctgggtcatagcccacgagtgcggccaccacgccttcagcgactac

SEQ ID NO: 10481 - DNA, 356 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgacgcctggcctctctactgggcctgccaagggtgcgtcctaaccggcgtctgggtcatagcccacgagtgcggccaccacgccttcagcgactac

SEQ ID NO: 10482 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaacgggcctctgggtcatcgcccacgaatgcggccaccacgccttcagcgactac

SEQ ID NO: 10483 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctggcccctctactgggcctgccaaggctgcgtcctaacgggcctctgggtcatagcccacgagtgcggccaccacgccttcagcgactac

SEQ ID NO: 10484 - DNA, 344 bp, Artificial
  Mutation in BnaC.FAD2.a introduced by TALE nuclease pair BnFAD2_T01
caggatccatgggtgcaggtggaagaatgcaagtctctcctccctccagctcccccggaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 10485 - DNA, 312 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctaatacgtcgccaccacttacttccctctcctccctcaccctgtgcgtcctaaccggcgtctgggtcatagcccacgagtgcggccaccacgccttcagcgactac

SEQ ID NO: 10486 - DNA, 335 bp, Artificial
  Mutation in BnaC.FAD2.a introduced by TALE nuclease pair BnFAD2_T01
caggatccatgggtgcagggggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttagcctgccaagggtgcgtcctaaccggcgtctgggtcatagcccacgagtgcggccaccacgccttcagcgactac

SEQ ID NO: 10487 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagatagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 10488 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaaacaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 10489 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctggcccctctacggggcctgccaaggctgcgtcctaacgggcctctgggtcatcgcccacgaatgcggccaccacgccttcagcgactac

SEQ ID NO: 10490 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccaacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaacgggcctctgggtcatagcccacgagtgcggccaccacgccttcagcgactac

SEQ ID NO: 10491 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctgccaagggtgcgtcctacccggcgtctgggtcatagcccacgagtgcggccaccacgccttcagcgactac

SEQ ID NO: 10492 - DNA, 332 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctctactgggcctgccaagggtgcgtcctaaccggcgtctgggtcatcgcccacgaatgcggccaccacgccatcagcgactac

SEQ ID NO: 10493 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaacctctctcctactctggcctctctactgggcctgccaagggtgcgtcctaaccggcgtctgggtcatagcccacgagtgcggccaccacgccttcagcgactac

SEQ ID NO: 10494 - DNA, 354 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctccttcgccctggcctctctactgggcctgccaagggtgcgtcctcaccggcgtctgggtcatagcccacgagtgcggccaccacgccttcagcgactac

SEQ ID NO: 10495 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctcccctctctactgggcctgccaagggtgcgtcctaacgggcctctgggtcatagcccacgagtgcggccaccacgccttcacgacta

SEQ ID NO: 10496 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctaccacgtcgccaccccttacttccctctcctccctcaccctctctcctactcctggcctctctactgggcctgccaagggtgcgtcctaacgggcctctgggtcatcgcccacgaatgcggccaccacgccttcagcgactac

SEQ ID NO: 10497 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtcctaaccggcgtctgggtcatagcccacgagtgcggccaccacgccttcagcgactac

SEQ ID NO: 10498 - DNA, 348 bp, Artificial
  Mutation in BnaC.FAD2.a introduced by TALE nuclease pair BnFAD2_T01
caggatccagggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 10499 - DNA, 348 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtaatagcccacgagtgcggccaccacgccttcagcgactac

SEQ ID NO: 10500 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcggcctctctactgggcctgccaagggtgcgtcctaaccggcgtctgggtcatagcccacgagtgcggccaccacgccttcagcgactac

SEQ ID NO: 10501 - DNA, 345 bp, Artificial
  Mutation in BnaC.FAD2.a introduced by TALE nuclease pair BnFAD2_T01
cagaatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaacgggcctctgggtcatagcccacgagtgcggccaccacgccttcagcgactac

SEQ ID NO: 10502 - DNA, 350 bp, Artificial
  Mutation in BnaC.FAD2.a introduced by TALE nuclease pair BnFAD2_T01
caggatccatgggtgcaaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 10503 - DNA, 395 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgcccccacttacttccctctcctccctccccctccctccgccgtcgccgcaagctcgtcctggctagcggtccgcgtattaaatgcggcctggcctctctacggggcctgccaagggtgcgtcctaaccggcgtctgggtcatagcccacgagtgcggccaccacgccttcagcgactac

SEQ ID NO: 10504 - DNA, 348 bp, Artificial
  Mutation in BnaC.FAD2.a introduced by TALE nuclease pair BnFAD2_T01
caggatccatgggtgcaggcggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 10505 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcctgccaaggctgcgtcctaacgggcctctgggtcatagcccacgagtgcggccaccacgccttcagcgactac

SEQ ID NO: 10506 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcggctac

SEQ ID NO: 10507 - DNA, 352 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccgccctggcctctctactgggcctgccaagggtgcgtcctaaccggcgtctgggtcatagcccacgagtgcggccaccacgccttcagcgactac

SEQ ID NO: 10508 - DNA, 356 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccgccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 10509 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 10510 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcaatgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgagtgcggccaccacgccttcagcgactac

SEQ ID NO: 10511 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctggcctctctactgggcctgccaagggtgcgtcctaaccggcgtctgggtcatagcccacgaatgcggccaccacgccttcagcgactac

SEQ ID NO: 10512 - DNA, 348 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccatcagcgactac

SEQ ID NO: 10513 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccctggcctctccactgggcctgccaagggtgcgtcctaaccggcgtctgggtcatagcccacgagtgcggccaccacgcctttagcgactac

SEQ ID NO: 10514 - DNA, 422 bp, Artificial
  Mutation in BnaC.FAD2.a introduced by TALE nuclease pair BnFAD2_T01
caggatccatgggtgcatgtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgttgccggtgctgtgccaggcctacggcttgaccccggagcaggtggtggccatcgccagcaatattggtgctggcccctctactgggcctgccaagggtgcgtcctaaccggcgtctgggtcatagcccacgagtgcggccaccacgccttcagcgactac

SEQ ID NO: 10515 - DNA, 324 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcgccaagggtgcgtcctaaccggcgtctgggtcatagcccacgagtgcggccaccacgccttcagcgactac

SEQ ID NO: 10516 - DNA, 325 bp, Artificial
  Mutation in BnaC.FAD2.a introduced by TALE nuclease pair BnFAD2_T01
caggatctatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggctgcgtcctaaccggcgtctgggtcatagcccacgagtgcggccaccacgccttcagcgactac

SEQ ID NO: 10517 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctatctcatctgggccatcatcatagcctcctgcttctactccgtccccaccacttacttccctcgcctccctcaccctctcccctacttcgtggtggcctctctactgggcctgccaagggtgcgtcctaaccggcgtctgggtcatagcccacgagtgcggccaccacgccttcagcgactac

SEQ ID NO: 10518 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctgtctcctacctcatctgggacatcatcatagcctcctgcttctactacgtcgccaccacttacttccctctcctccctcaccctctctctgcctctctactgggcctgccaagggtgcgtcctaaccggcgtctgggtcatagcccacgagtgcggccaccacgccttcagcgactac

SEQ ID NO: 10519 - DNA, 343 bp, Artificial
  Mutation in BnaC.FAD2.a introduced by TALE nuclease pair BnFAD2_T01
caggatccatgggtgcaggtggaagaatgcaagtctatcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 10520 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctcactcaccctctctcctactgctggcctctctactgggcctgccaagggtgcgtcctaaccggcgtctgggtcatagcccacgagtgcggccaccacgccttcagcgactac

SEQ ID NO: 10521 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgttccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 10522 - DNA, 324 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcgccaagggtgcgtcctaaccggcgtctgggtcatagcccacgagtgcggccaccacgccttcagcgactac

SEQ ID NO: 10523 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctaggcctctctactgggcctgccaaggctgcgtcctaacgggcctctgggtcatagcccacgagtgcggccaccacgccttcagcgactac

SEQ ID NO: 10524 - DNA, 380 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctccttcacagtggtccggcgcacgcgctctggaggcctgcctctctactgggcctgccaagggtgcgtcctaaccggcgtctgggtcatagcccacgagtgcggccaccacgccttcagcgactac

SEQ ID NO: 10525 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctccggcctctctactgggcctgccaagggtgcgtcctaaccggcgtctgggtcatagcccacgagtgcggccaccacgccttcagcgacac

SEQ ID NO: 10526 - DNA, 343 bp, Artificial
  Mutation in BnaC.FAD2.a introduced by TALE nuclease pair BnFAD2_T01
caggatccatcggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaacgggcctctgggtcatagcccacgagtgcggccaccacgccttcagcgactac

SEQ ID NO: 10527 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaacgggcctctgggtcatcgcccacgaatgcggccaccacgccttcagcgactac

SEQ ID NO: 10528 - DNA, 401 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttcgccataagctgccaggcatcaaactaagcagaaggccatccgtccataggctggcctctctactgggcctgccaagggtgcgtcctagccggcgtctgggtgatagcccacgagtgcggccaggacgccttcagcgactgc

SEQ ID NO: 10529 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctcggcctctctactgggcctgccaagggtgcgtcctaaccggcgtctgggtcatagcccacgagtgcggccaccacgccttcagcgactac

SEQ ID NO: 10530 - DNA, 321 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaatggtgcgtcctaaccggcgtctgggtcatagcccacgagtgcggccaccacgccttcagcgactac

SEQ ID NO: 10531 - DNA, 348 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctcctgggcctgcccagggtgcgtgctaaccggcgtctgggtcatagcccacgagtgcggccaccacgccttcagcgactac

SEQ ID NO: 10532 - DNA, 312 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatcgcccacgaatgcggccaccacgccttcagcgactac

SEQ ID NO: 10533 - DNA, 321 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaaccggcgtctgggtcatagcccacgagtgcggccaccacgccttcagcgactac

SEQ ID NO: 10534 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactgtcggagaactcaagaaagcaatcccaccgcactgtttcaaacgctctatccctcgctctttctcctacctcatctgggacatcatcatagcctcctgcttctactacgtcgccaccacttacttccctctcctccctcaccctctctcctgcctggcctctctactgggcctgccaagggtgcgtcctaaccggcgtctgggtcatagcccacgagtgcggccaccacgccttcagcgactac

SEQ ID NO: 10535 - DNA, 347 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtatgggtcatagcccacgagtgcggccaccacgccttcagcgactac

SEQ ID NO: 10536 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 10537 - DNA, 342 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttctactgggcctgccaagggtgcgtcctaaccggcgtctgggtcatagcccacgagtgcggccaccacgccttcagcgactac

SEQ ID NO: 10538 - DNA, 300 bp, Artificial
  Mutation in BnaC.FAD2.a introduced by TALE nuclease pair BnFAD2_T01
caggatccatgggtgcaggtggaagaatgcaagtgtctcctccctccaagaagtcggaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccaagggtgcgtcctaacgggcctctgggtcatcgcccacgaatgcggccaccacgccttcagcgactac

SEQ ID NO: 10539 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaagggtgcgtcctaaccggcgtctgggtcatcgcccacgaatgcggccaccacgccttcagcgactac

SEQ ID NO: 10540 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcatctgggacatcatcatagcctcctgcttctactacgtcgccaccacttacttccctctcctccctcaccctctctcctccttcgcctttggcctctctactgggcctgccaagggtgcgtcctaaccggcgtctgggtcatagcccacgagtgcggccaccacgccttcagcgactac

SEQ ID NO: 10541 - DNA, 332 bp, Artificial
  Mutation in BnaC.FAD2.a introduced by TALE nuclease pair BnFAD2_T01
caggatccatggatgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggaactgccaagggtgcgtcctaaccggcgtctgggtcatagcccacgagtgcggccaccacgccttcagcgactac

SEQ ID NO: 10542 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgcttcaaacgctccatccctcgctctttctcctacctcatctggtacatcatcatagcctcctgcttctactccgtccccaccacttacttccctctcctccctccccctctctcctccttcgcggcctctctactgggcctgccaagggtgcgtcctaaccggcgtctgggtcatagcccacgagtgcggccaccacgccttcagcgactac

SEQ ID NO: 10543 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcccctccctcaccctctctcctacttctggcctctctactgggcctgccaagggtgcgtcctaaccggcgtctgggtcatagcccgcgagtgcggccaccacgccttcagcgactac

SEQ ID NO: 10544 - DNA, 348 bp, Artificial
  Mutation in BnaC.FAD2.a introduced by TALE nuclease pair BnFAD2_T01
caggatccatgggtgcaggtggatgaatgcaagtctctcctccctccagctcccccggaaccaacaccctcaaacgcgtcccctcggggcaccacccttccctctcggagacctcaagaaagcaatcccaccgcactgtttcaaacgctcgatcccccgctctttctcctacctcatctgggacatcatcatagccccctgcttctactacgtcgccaccacttacttccctctcctccctcaccctctctcctactttggcctctctactgggcctgccaagggtgcgtcctaacgggcctctgggtcatcgcccacgagtgcggccaccacgccttcagcgactac

SEQ ID NO: 10545 - DNA, 329 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctactgccaagggtgcgtcctaaccggcgtctgggtcatagcccacgagtgcggccaccacgccttcagcgactac

SEQ ID NO: 10546 - DNA, 352 bp, Artificial
  Mutation in BnaC.FAD2.a introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccgccctggcctctctactgggcctgccaaggctgcgtcctaacgggcctctgggtcatagcccacgagtgcggccaccacgccttcagcgactac

SEQ ID NO: 10547 - DNA, 337 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctactgggcctgccaagggtgcgtcctaaccggcgtctgggtcatagcccacgagtgcggccaccacgccttcagcgactac

SEQ ID NO: 10548 - DNA, 357 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactatgtcgccaccacttacttccctctcctccctcaccggtttgcgtattgccggtgcctggcctctctactgggcctgccaagggtgcgtcctaaccggcgtctgggtcatagcccacgagtgcggccaccacgccttcagcgactac

SEQ ID NO: 10549 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgctggcctctctactgggcctgccaaggctgcgtcctaacgggcctctgggtcatcgcccacgaatgcggccaccacgccttcagcgactac

SEQ ID NO: 10550 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctgaccggcgtctgggtcatagcccacgagtgcggccaccacgccttcagcgactac

SEQ ID NO: 10551 - DNA, 277 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctggaacatcatcatagcctcctgcttctactacgtcgccaccacttacttccctctcctccctcaccctctctcctacttcgcgccttcagcgactac

SEQ ID NO: 10552 - DNA, 341 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatctctactgggcctgccaagggtgcgtcctaaccggcgtctgggtcatagcccacgagtgcggccaccacgccttcagcgactac

SEQ ID NO: 10553 - DNA, 348 bp, Artificial
  Mutation in BnaC.FAD2.a introduced by TALE nuclease pair BnFAD2_T01
caggatccatgggtgcaggtggaagaatgcaagtgtctcctcgctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 10554 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctccttggcctctctactgggcctgccaagggtgcgtcctaacgggcctctgggtcatagcccacgagtgcggccaccacgccgtcagcgactac

SEQ ID NO: 10555 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtccgggtcatagcccacgagtgcggccaccacgccttcagcgactac

SEQ ID NO: 10556 - DNA, 312 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgtcaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 10557 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatggcctctctactgggcctgccaagggtgcgtcctaaccggcgtctgggtcatagcccacgagtgcggccaccacgccatcagcgactac

SEQ ID NO: 10558 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccaagggtgcgtcctaaccggcgtctgggtcatagcccgcgagtgcggccaccacgccttcagcgactac

SEQ ID NO: 10559 - DNA, 344 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttgcctctctactgggcctgccaagggtgcgtcctaaccggcgtctgggtcatagcccacgagtgcggccaccacgccttcagcgactac

SEQ ID NO: 10560 - DNA, 333 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctgccaagggtgcgtcctaaccggcgtctgggtcatagcccacgagtgcggccaccacgccttcacgactac

SEQ ID NO: 10561 - DNA, 321 bp, Artificial
  Mutation in BnaC.FAD2.a introduced by TALE nuclease pair BnFAD2_T01
caggatccatgggtgcaggtggaagaatgcaagtctctcctccctccagctcccccggaaccgacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaaccggcgtctgggtcatagcccacgagtgcggccaccacgccttcagcgactac

SEQ ID NO: 10562 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctggcctctctactgggcctgccaagggtgcgtcctaaccggcgtctgggtcatagcccacgagtgcggccaccacgccgtcagcgactac

SEQ ID NO: 10563 - DNA, 350 bp, Artificial
  Mutation in BnaC.FAD2.a introduced by TALE nuclease pair BnFAD2_T01
caggctccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttctggcctctctacggggcctgccaagggtgcgtcctaaccggcgtctgggtcatagcccacgagtgcggccaccacgccttcagcgactac

SEQ ID NO: 10564 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatatcccacgagtgcggccaccacgccttcagcgactac

SEQ ID NO: 10565 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccaagggtgcgtcctaaccggcgtctgggtcatagcccacgagtgcggccaccacgccttcagcgactac

SEQ ID NO: 10566 - DNA, 277 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgccttcagcgactac

SEQ ID NO: 10567 - DNA, 337 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctactgggcctgccaagggtgcgtcctaaccggcgtctgggtcatagcccacgagtgcgaccaccacgccttcagcgactac

SEQ ID NO: 10568 - DNA, 324 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcgccaagggtgcgtcctaaccggcgtctgggtcatagcccacgagtgcggccaccacgccttcagcgactac

SEQ ID NO: 10569 - DNA, 339 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccaaggctgcgtcctgacgggcctctgggtcatagcccgcgagtgcggccaccacgccttcagcgactac

SEQ ID NO: 10570 - DNA, 343 bp, Artificial
  Mutation in BnaC.FAD2.a introduced by TALE nuclease pair BnFAD2_T01
caggatccatgggtgcaggtggaagaatgcaagtctctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaggcctctctactgggcctgccaagggtgcgtcctaaccggcgtctgggtcatagcccacgagtgcggccaccacgccttcagcgactac

SEQ ID NO: 10571 - DNA, 355 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccaagggtgcgtcctaaccggcgtcttggtcatatcccgcgagtgcggccaccacgccttcagcgactac

SEQ ID NO: 10572 - DNA, 374 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccaggcttatcttggacaagaagaagatcgctctctactgggcctgccaagggtgcgtcctaaccggcgtctgggtcatagcccacgagtgcggccaccacgccttcagcgactac

SEQ ID NO: 10573 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgttggcctctctactgggcctgccaagggtgcgtcctgaccggcgtctgggtcatagcccgcgagtgcggccaccacgccttcagcgactac

SEQ ID NO: 10574 - DNA, 341 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctctactgggcctgccaagggtgcgtcctaaccggcgtctgggtcatagcccacgagtgcggccaccacgccttcagcgactac

SEQ ID NO: 10575 - DNA, 339 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccaagggtgcgtcctaaccggcgtctgggtcatagcccacgagtgcggccaccacgccttcagcgactac

SEQ ID NO: 10576 - DNA, 347 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctattggcctctctactgggcctgccaagggtgcgtcctaaccggcgtctgggtcatagcctacgagtgcggccaccacgccttcagcgactac

SEQ ID NO: 10577 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccatctcctccctcaccctctctcctacttctctctactgggcctgccaagggtgcgtcctaaccggcgtctgggtcatagcccacgagtgcggccaccacgccttcagcgactac

SEQ ID NO: 10578 - DNA, 404 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggataactcaagaaagcaatcccaccgcactgtttcaaacgctcgatccctcgctctttctcctacctcatctgggacatcatcatagcctcctgcttctactacgtcgccaccacttacttccctctcctccctcaccctctctcggatttgtcctactcaggagagcgttcaccgacaaacaacagataaaacgaaaggcccgcctggcctctctactgggcctgccaagggtgcgtcctaaccggcgtctgggtcatagcccacgagtgcggccaccacgccttcagcgactac

SEQ ID NO: 10579 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattggcctctctactgggcctgccaagggtgcgtcctaaccggcgtctgggtcatcgcccacgaatgcggccaccacgccttcagcgactac

SEQ ID NO: 10580 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccatcagcgactac

SEQ ID NO: 10581 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttcccactcctccctcaccctctctcctactggcctctctactgggcctgccaagggtgcgtcctaaccggcgtctgggtcatagcccacgagtgcggccaccacgccttcagcgactac

SEQ ID NO: 10582 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaaggctgcgtcctaacgggcctctgggtcatcgcccacgaatgcggccaccacgccttcagcgactac

SEQ ID NO: 10583 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 10584 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccgtcagcgactac

SEQ ID NO: 10585 - DNA, 438 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttaaggtttaactttgttttagggcgactgccctgctgcgtaacatcgttgctggacagcatcgatatcgccgatctacgcacgctcgacctggcctctctactgggcctgccaagggtgcgtcctaaccggcgtctgggtcatagcccacgagtgcggccaccacgccttcagcgactac

SEQ ID NO: 10586 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctaccaagggtgtgtcctaaccggcgtctgggtcatagcccacgagtgcggccaccacgccttcagcgactac

SEQ ID NO: 10587 - DNA, 341 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctctactgggcctgccaagggtgcgtcctaaccggcgtctgggtcatagcccacgagtgcggccaccacgccttcagcgactac

SEQ ID NO: 10588 - DNA, 335 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccaagggtgcgtcctaaccggcgtctgggtcatagcccacgagtgcggccaccacgccttcagcgactac

SEQ ID NO: 10589 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcctctctactgggcctgccaagggtgcgtcctaacgggcctctgggtcatcgcccacgaatgcggccaccacgccttcagcgactac

SEQ ID NO: 10590 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggttcgtcctaaccggcgtctgggtcatagcccacgagtgcggccaccacgccttcagcgactac

SEQ ID NO: 10591 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 10592 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcctggcctctctactgggcctgccaagggtgcgtcctaaccggcgtctgggtcatagcccacgagtgcggccaccacgccttcagcgactac

SEQ ID NO: 10593 - DNA, 436 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccctggctggcgatggccaccacctgctccggggtcaagccgtgggcctggcatctctgccaaatagttgggagccaatgagggcaggcctctctactgggcctgccaagggtgcgtcctaaccggcgtctgggtcatagcccacgagtgcggccaccacgccttcagcgactac

SEQ ID NO: 10594 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccatctcctccctcaccctctctcctactctctactgggcctgccaagggtgcgtcctaaccggcgtctgggtcatagcccacgagtgcggccaccacgccttcagcgactac

SEQ ID NO: 10595 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctcctggcctctctactgggcctgccaagggtgcgtcctaacgggcctctgggtcatagcccacgagtgcggccaccacgccttcagcgactac

SEQ ID NO: 10596 - DNA, 346 bp, Artificial
  Mutation in BnaC.FAD2.a introduced by TALE nuclease pair BnFAD2_T01
caggatccatggggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaaccggcgtctgggtcatagcccacgagtgcggccaccacgccttcagcgactac

SEQ ID NO: 10597 - DNA, 352 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccgccctggcctctctactgggcctgccaaggctgcgtcctaacgggcctctgggtcatagcccacgagtgcggccaccacgccttcagcgactac

SEQ ID NO: 10598 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctggggcatcatcatagcctcctgcttctactacgtcgccaccacttacttccctctcctccctcaccctctctcctactactgggcctgccaagggtgcgtcctaaccggcgtctgggtcatagcccacgagtgcggccaccacgccttcagcgactac

SEQ ID NO: 10599 - DNA, 352 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctactgcgctggcctctctactgggcctgccaaggctgcgtcctaacgggcctctgggtcatagcccacgaatgcggccaccacgccttcagcgactac

SEQ ID NO: 10600 - DNA, 398 bp, Artificial
  Mutation in BnaC.FAD2.a introduced by TALE nuclease pair BnFAD2_T01
caggatccatgggtgcatgtggaagaatgcaagtgtctcctccctccaagaagtctgaaaccgacaccatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgccttggcaacgctgcgatcatgtcctgatacttgacagcgacggtccctggcctctctactgggcctgccaagggtgcgtcctaaccggcgtctgggtcatagcccacgagtgcggccaccacgccttcagcgactac

SEQ ID NO: 10601 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcggcctctatactgggcctgccaagggtgcgtcctaaccggcgtctgggtcatagcccacgagtgcggccaccacgccttcagcgactac

SEQ ID NO: 10602 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgcccgatccctcgctctttctcctacctcatctgggacatcatcatagcctcctgcttctactacgtcgccaccacttacttccctctcctccctccccctctctcctatggcctctctactgggcctgccaagggtgcgtcctaaccggcgtctgggtcatagcccacgagtgcggccaccacgccttcagcgactac

SEQ ID NO: 10603 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtccgagaactcaagaaagcaatcccaccgcactgtttcaaacgctcgatcccccgctctttctcctacctcatctgggacatcatcatagcctcctgcttctcctacctcgccaccacttacttccctctcctccctcaccctctctcctcctgctggcccctctactgggcctgccaagggtgcgtcctaaccggcgtctgggtcatagcccacgagtgcggccaccacgccttcagcgactac

SEQ ID NO: 10604 - DNA, 300 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtctctctactgggcctgccaagggtgcgtcctaaccggcgtctgggtcatagcccacgagtgcggccaccacgccatcagcgactac

SEQ ID NO: 10605 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactatgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 10606 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgccttcagcgactac

SEQ ID NO: 10607 - DNA, 321 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgtgtcctaaccggcgtctgggtcatagcccacgagtgcggccaccacgccttcagcgactac

SEQ ID NO: 10608 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacttcgccaccacttacttccctctcctccctcaccctctctcctactttggcgctggccgctctactgggcctgccaagggtgcgtcctaaccggcgtctgggtcatagcccacgagtgcggccaccacgccttcagcgactac

SEQ ID NO: 10609 - DNA, 346 bp, Artificial
  Mutation in BnaC.FAD2.a introduced by TALE nuclease pair BnFAD2_T01
caggatccatgggtgcaggtggaagaatgcaagtgtctcctccctccaaaaagtcttaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 10610 - DNA, 349 bp, Artificial
  Mutation in BnaC.FAD2.a introduced by TALE nuclease pair BnFAD2_T01
caggatccatgggtgcaggtggaagaatgcaagtgtctcctcccaccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 10611 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtttggcctctctactgggcctgccaagggtgcgtcctaaccggcgtctgggtcatagcccacgagtgcggccaccacgccttcagcgactac

SEQ ID NO: 10612 - DNA, 356 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 10613 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctaggcctctctactgggcctgccaagggtgcgtcctaacgggcctctgggtcatcgcccacgaatgcggccaccacgccttcagcgactac

SEQ ID NO: 10614 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgtcaagggtgcgtcctaaccggcgtctgggtcatagcccacgagtgcggccaccacgccttcagcgactac

SEQ ID NO: 10615 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 10616 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcgccctctctactgggcctgccaagggtgcgtcctaaccggcgtctgggtcatagcccacgagtgcggccaccacgccttcagcgactac

SEQ ID NO: 10617 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccaagggtgcgtcctaaccggcctctgggtcatagcccacgagtgcggccaccacgccttcagcgactac

SEQ ID NO: 10618 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttgggcctctctactgggcctgccaagggtgcgtcctaaccggcgtctgggtcatagcccacgagtgcggccaccacgccttcagcgactac

SEQ ID NO: 10619 - DNA, 387 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgccatcgtggctggcgatggccaccacctgctcctggcctctctactgggcctgccaagggtgcgtcctaaccggcgtctgggtcatagcccacgagtgcggccaccacgccttcagcgactac

SEQ ID NO: 10620 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaaggttgcgtcctaaccggcctctgggtcatagcccacgagtgcggccaccacgccttcagcgactac

SEQ ID NO: 10621 - DNA, 393 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctaacggtgcaggcgctgttgccggtgctgtgccaggcccacggcttgacccctggcctctctactgggcctgccaagggtgcgtcctaaccggcgtctgggtcatagcccacgagtgcggccaccacgccttcagcgactac

SEQ ID NO: 10622 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcccctctactgggcctgccaaggctgcgtcctaacgggcctctgggtcatcgcccacgaatgcggccaccacgccttcagcgactac

SEQ ID NO: 10623 - DNA, 348 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaacgggcctctgggtcatagcccacgagtgcggccaccacgccttcagcgactac

SEQ ID NO: 10624 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaaccggcgtctgggtcatagcccacgagtgcggccaccacgccttcagcgactac

SEQ ID NO: 10625 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggccatagcccacgagtgcggccaccacgccttcagcgactac

SEQ ID NO: 10626 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccacctcactgcttcaaacgctccatccctcgctctttctcctacctcatctgggacatcatcatagcctcctgcttctactacgtcgccaccacttacttccctctcctccctcaccctctctcctgcctctctactgggcctgccaagggtgcgtcctaaccggcgtctgggtcatagcccacgagtgcggccaccacgccttcagcgactac

SEQ ID NO: 10627 - DNA, 329 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgccaagggtgcgtcctaaccggcgtctgggtcatagcccacgagtgcggccaccacgccttcagcgactac

SEQ ID NO: 10628 - DNA, 331 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 10629 - DNA, 385 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccgtgggcttggcacagcaccggcaacagccgctggaccgtctccagcgcctgcctggcctctctactgggcctgccaagggtgcgtcctaaccggcgtctgggtcatagcccacgagtgcggccaccacgccttcagcgactac

SEQ ID NO: 10630 - DNA, 325 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggctgcgtcctaaccggcgtctgagtcatagcccacgagtgcggccaacacgccttcagcgactac

SEQ ID NO: 10631 - DNA, 326 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgctcctactacgtcgccaccacttacttccctctcctccccctctactgggcctgccaaggctgcgtcctaacgggcctctgggtcatcgcccacgaatgcggccaccacgccttcagcgactac

SEQ ID NO: 10632 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaaccggcgtctgggtcatagcccacgagtgcggccaccacgccttcagcgactac

SEQ ID NO: 10633 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaaggctgcgtcctaacgggcctctgggtcatagcccacgagtgcggccaccacgccttcagcgactac

SEQ ID NO: 10634 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaacgggcctctgggccatagcccacgagtgcggccaccacgccttcagcgactac

SEQ ID NO: 10635 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaacgggcctctgggtcatcgcccacgaatgcggccaccacgccttcagcgactac

SEQ ID NO: 10636 - DNA, 347 bp, Artificial
  Mutation in BnaC.FAD2.a introduced by TALE nuclease pair BnFAD2_T01
cagatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 10637 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctggcctctctactgggccggccaagggtgcgtcctaaccggcgtctgggtcatagcccacgagtgcggccaccactccttcagcgactac

SEQ ID NO: 10638 - DNA, 462 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccctcctcccgcgttgaccaacgcccccctcgtcgccttggcctgcctcggcgggcgtcctgcgctggatgcagtgaaaaagggattgggggatcctaccagccgttcccagctggacgcctggcctctctactgggcctgccaagggtgcgtcctaaccggcgtctgggtcatagcccacgagtgcggccaccacgccttcagcgactac

SEQ ID NO: 10639 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcatgccaagggtgcgtcctaaccggcgtctgggtcatagcccacgagtgcggccaccacgccttcagcgactac

SEQ ID NO: 10640 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 10641 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccggcctctctactgggcctgccaagggtgcgtcctaaccggcgtctgggtcatagcccacgagtgcggccaccacgccttcagcgactac

SEQ ID NO: 10642 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccgcgagtgcggccaccacgcctgcagcgactac

SEQ ID NO: 10643 - DNA, 335 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttagcctgccaagggtgcgtcctaaccggcgtctgggtcatagcccacgagtgcggccaccacgccttcagcgactac

SEQ ID NO: 10644 - DNA, 300 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtctctctactgggcctgccaagggtgcgtcctaaccggcgtctgggtcatagcccacgagtgcggccaccacgccttcagcgactac

SEQ ID NO: 10645 - DNA, 404 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcggatttgtcctactcaggagagcgttcaccgacaaacaacagataaaacgaaaggcccgcctggcctctctactgggcctgccaagggtgcgtcctaaccggcgtctgggtcatagcccacgagtgcggccaccacgccttcagcgactac

SEQ ID NO: 10646 - DNA, 342 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcgcctggcctctctactgggcctgccaagggtgcgtcctaacgggcctctgggtcatcgcccacgaatgcggccaccacgccgtcagcgactac

SEQ ID NO: 10647 - DNA, 346 bp, Artificial
  Mutation in BnaC.FAD2.a introduced by TALE nuclease pair BnFAD2_T01
caggatctatgggtgcaggtggaagaatgcaagtgtctcctccatccaagaagtctgaaaccgacaacatcaagcgagtaccctgcgagacaccgcccttcactgtcggagaactcaagaaagcaatcccaccgcactgtttcaaacgctcgatccctcgctctttctccttcctcatctgggacatcatcatagcctcctgcttctactacgtcgccaccacttacttccctctcctccctcaccctctctcctacggcctctctactgtgcctgccaagggtgcgtcctaaccgtcttctgggtcatagcccacgagtgcggccaccactccttcagcgactac

SEQ ID NO: 10648 - DNA, 349 bp, Artificial
  Mutation in BnaC.FAD2.a introduced by TALE nuclease pair BnFAD2_T01
caggatccatgggtgcaggtggaaggatgcaagtgtctcctccctccaagaagtctgaaaccgacaccatcaagcgcgtaccctgcgagacaccgcccttcactgtcggataactcaagaaagcaatcccaccgcactgtttcaaacgctcgatccctcgctctttctcctacctcatctctgacatcatcatagcctcctgcttctactacgtcgccaccacttacttccctctcctccctcaccctctctcctgcttaggcctctctactgggcctcccaagggtgcgtccttaccgtcgtctgggtcatagcccacgagtgcttccaccacaccttcagcgactac

SEQ ID NO: 10649 - DNA, 354 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccaagggtgcgtcctaaccggcgtctgggtcatagcccacgagtgcggccaccacgccttcagcgactac

SEQ ID NO: 10650 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctggtacatcatcatagcctcctgcttctactacgtcgccaccacttacttccctctcctccctcaccctctctcccacttgcctctctactgggcctgccaagggtgcgtcctaaccggcgtctgggtcatagcccacgagtgcggccaccacgccttcagcgactac

SEQ ID NO: 10651 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgggcctgccaagggtgcgtcctaaccggcgtctgggtcatagcccacgagtgcggccaccacgccttcagcgactac

SEQ ID NO: 10652 - DNA, 324 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcgccaagggtgcgtcctaaccggcgtctgggtcatagcccgcgagtgcggccaccacgccttcagcgactac

SEQ ID NO: 10653 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccccctctcctacttggcctctctcctgggcctgccaagggtgcgtcctaaccggcgtctgggtcatagcccacgagtgcggccaccacgccttcagcgactac

SEQ ID NO: 10654 - DNA, 318 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccaagggtgcgtcctaaccggcgtctgggtcatagcccacgagtgcggccaccacgccttcagcgactac

SEQ ID NO: 10655 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtccgaacgggcctctgggtcatagcccacgagtgcggccaccacgccatcagcgactac

SEQ ID NO: 10656 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctaaccctctctcctactttggcctctctactgggcctgccaagggtgcgtcctaaccggcgtctgggtcatagcccacgagtgcggccaccacgccttcagcgactac

SEQ ID NO: 10657 - DNA, 351 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcggcctctctactgggcctgccaagggtgcgtcctaaccggcgtctgggtcatagcccacgagtgcggccaccacgccttcagcgactac

SEQ ID NO: 10658 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcatgcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctggcctctctactgggcctgccaagggtgcgtcctaaccggcgtctgggtcatagcccacgagtgcggccaccacgccttcagcgactac

SEQ ID NO: 10659 - DNA, 349 bp, Artificial
  Mutation in BnaC.FAD2.a introduced by TALE nuclease pair BnFAD2_T01
caggatccatgggtgcaggtggaagaatgcaagtctctcctccctccagctccctcggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaacgggcctctgggtcatagcccacgagtgcggccaccacgccttcagcgactac

SEQ ID NO: 10660 - DNA, 403 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgaatacctgtccgcctttctcccttcgggaagcgtggcgctttctcatagctcaggcctctctactgggcctgccaagggtgcgtcctaaccggcgtctgggtcatagcccgcgagtgcggccaccacgccatcagcgactac

SEQ ID NO: 10661 - DNA, 277 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctacttcgcgccttcagcgactac

SEQ ID NO: 10662 - DNA, 419 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactaagactgggcctttcgttttatcggttgtttgtcggtgaacgctctcctgagtaggacaaatccgctcccttggcttttttactgggcctgccaagggtgcgtcctaaccggcgtctgggtcatagcccacgagtgcggccaccacgccgtcagcgactac

SEQ ID NO: 10663 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagcgcggccaccacgccttcagcgactac

SEQ ID NO: 10664 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttggcccctctacggggcctgccaaggctgcgtcctaacgggcctctgggtcatcgcccacgaatgcggccaccacgccttcagcgactac

SEQ ID NO: 10665 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggccagccaagggtgcgtcctaaccggcgtctgggtcatagcccacgagtgcggccaccacgccttcagcgactac

SEQ ID NO: 10666 - DNA, 329 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcatactgccaagggtgcgtcctaaccggcgtctgggtcatagcccacgagtgcggccaccacgccttcagcgactac

SEQ ID NO: 10667 - DNA, 387 bp, Artificial
  Mutation in BnaC.FAD2.a introduced by TALE nuclease pair BnFAD2_T01
caggatccatgggtgcaggtggaagaatgcaagtgtctcctccctcccaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgccatcgtggctggcgatggccaccacctgctcctggcctctctactggtcctgccaagagtgcgtcctaaccggcgtctgggtcatagcccacgagtgcggccaccacgcctgcagcgactac

SEQ ID NO: 10668 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgctagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccctcagcgactac

SEQ ID NO: 10669 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctgccaagggtgcgtcctaaccggcgtctgggtcatagcccacgagtgcggccaccacgccttcagcgactac

SEQ ID NO: 10670 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccgcctggcctctctactgggcctgccaagggtgcgtcctaacgggcctctgggtcatagcccacgagtgcggccaccacgccttcagcgactac

SEQ ID NO: 10671 - DNA, 347 bp, Artificial
  Mutation in BnaC.FAD2.a introduced by TALE nuclease pair BnFAD2_T01
caggatccatgggtgcaggtggaggaatgcaagtgtctcctccctccaagaagtctgaaaccgacaccatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 10672 - DNA, 446 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcagcggtggtttttttgtttgcaagcagcagattacgcgcagaaaaaaaggatctcaggtggtggccatcgccggcaatggcggtggcaagcaggcgctgcctctctactgggcctgccaagggtgcgtcctaaccggcgtctgggtcatagcccacgagtgcggccaccacgccttcagcgactac

SEQ ID NO: 10673 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctttcctggcctctctactgggcctgccaagggtgcgtcctaacgggcctctgggtcatagcccacgagtgcggccaccacgccttcagcgactac

SEQ ID NO: 10674 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctacctcatctgggacatcattatagcccctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 10675 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggctgcgtcctaacgggcctctgggtcatcgcccacgaatgcggccacccagccttcagcgactac

SEQ ID NO: 10676 - DNA, 341 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctggcctctctactgggcctgccaagggtgcgtcctaaccggcgtctgggtcatagcccacgagtgcggccaccacgccttcagcgactac

SEQ ID NO: 10677 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcctcccccaccctctcccttacctccgcctggcctctctactgggcctgccaatggtgcgtccgaaccggcgtctgggtcatagcccacgagtgcggccaccacgccttgagcgactac

SEQ ID NO: 10678 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatctcaccgcactgtttcaaacgctcgatccctcgctctttctcctacctcatctgggacatcatcatagcctcctgcctctactacgtcgccaccacttacttccctctcctccctcaccctctctcctactcctctctactgggcctgccaagggtgcgtcctaaccggcgtctgggtcatagcccacgagtgcggccaccacgccttcagcgactac

SEQ ID NO: 10679 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcctctgggtcatagcccacgagtgcggccaccacgccttcagcgactac

SEQ ID NO: 10680 - DNA, 340 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctccctcctactctactgcgcctgccaagggtgcgtcctaaccggcgtctgggtcatagcccacgagtgcggccaccacgccttcagcgactac

SEQ ID NO: 10681 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggtgcctggcctctctaccgggcctgccaagggtgcgtcctaaccggcgtctgggtcatagcccacgagtgcggccaccacgccttcagcgactac

SEQ ID NO: 10682 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 10683 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccccgagtgcggccaccacgccttcagcgactac

SEQ ID NO: 10684 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcaccatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactc

SEQ ID NO: 10685 - DNA, 339 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcacgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgggtcatagcccacgagtgcggccaccacgccttcagcgactac

SEQ ID NO: 10686 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagccctcgagtgcggccaccactccttcagcgactac

SEQ ID NO: 10687 - DNA, 403 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcttcccgccatcgtggctggcgatggccaccccctgctccggggtcaagccgttggcctctctactgggcctgccaagggtgcgtcctaacgggcctctgggtcatcgcccacgaatgcggccaccacgccttcagcgacta

SEQ ID NO: 10688 - DNA, 350 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctacttctggcctctctactgtgcctgccaagggtgcgtcctaacgggcctctgggtcatagcccacgagtgcggccaccacgccttcagcgactac

SEQ ID NO: 10689 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaagggtgcgtcctaaccggcgtctgggtcatcgcccacgaatgcggccaccacgccttcagcgactac

SEQ ID NO: 10690 - DNA, 338 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctccctctctactgggcctgccaagggtgcgtcctaaccggcgtctgggtcatagcccacgagtgcggccaccacgccttcagcgactac

SEQ ID NO: 10691 - DNA, 343 bp, Artificial
  Mutation in BnaC.FAD2.a introduced by TALE nuclease pair BnFAD2_T01
caggatccatgggtgcaggtggaagaatgcaagtgtctcctccctacaagaagtctgaaaccgacaccatcaagcgcgtaccctgcgagacaccgcccttcactgtcggagaactcaagaaagcaatcccaccgcactgtttcaaacgctcgatccctcgctctttctcctacctcacctgggacatcatcatagcctcctgcttctactacgtcgccaccacttacttccctcacctccctcaccctctctcctatcactctactgagcctgccaagggtgcgtcctaaccggcttctgggtcatagcccacaagtgcggccaccacgccatcaacgactac

SEQ ID NO: 10692 - DNA, 424 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctccagcgcctgcttgccgccatcgtggctggcgatgtccaccacctgctggggggtcaagccgtgggcctggcatggcctctctactgggcctgccaagggtgcgtcctaaccggcgtctgggtcatagcccacgagtgcggccaccacgccttcagcgactac

SEQ ID NO: 10693 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgatggcctctctactgggcctgccaagggtgcgtcctaaccggcgtctgggtcatagcccacgagtgcggccaccacgccatcagcgactac

SEQ ID NO: 10694 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctcaccggcgtctgggtcatagcccacgagtgcggccaccactccttcagcgactac

SEQ ID NO: 10695 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 10696 - DNA, 323 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagggtgcgtcctaaccggcgtctgggtcatagcccacgagtgcggccaccacgccttcagcgactac

SEQ ID NO: 10697 - DNA, 343 bp, Artificial
  Mutation in BnaC.FAD2.a introduced by TALE nuclease pair BnFAD2_T01
caggatccatgggcgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcgcctggcccctctactgggcctgccaaggctgcgtcctaacgggcctctgggtcatcgcccacgaatgcggccaccacgcctcagcgactac

SEQ ID NO: 10698 - DNA, 403 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttcggatacctgtccgcctttctcccttcgggaagcgtggcgctttctcatagctcaggcctctctactgggcctgccaagggtgcgtcctaaccggcgtctgggtcatagcccacgagtgcggccaccacgccttcagcgactac

SEQ ID NO: 10699 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggctgccaagggtgcgtcctaaccggcgtctgggtcatagcccacgagtgcggccaccacgccttcagcgactac

SEQ ID NO: 10700 - DNA, 339 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccaacaccatcaagcgcgtaccctgcgagacaccccccttcactgtcggagaactcaagaaagcaatcccaccgcactgtttcaaacgctcgatccctcgctctttctcctacctcatctgggacatcatcataccctcctgcttctactactccgccaccacttccttccctctcctccctcaccctctggcctctctactgggcctgccaagggtgcgtcctaaccggcgtctgggtcatagcccacgagtgcggccaccacgccttcagcgactac

SEQ ID NO: 10701 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacctcatcatagcctcctgcttctactacctcgccaccacttacttccctctcctccctcaccccctctggcctctctactgggcctgccaagggtgcgtcctaaccggcgtctgggtcatagcccacgagtgcggccaccacgccttcagcgactac

SEQ ID NO: 10702 - DNA, 438 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccagctgggccttgtagttgccctggaagtggccggacacgaacaggaacttgaactcggtcacgctggaggggtacaccttccacctggcctctctactgggcctgccaagggtgcgtcctaaccggcgtctgggtcatagcccacgagtgcggccaccacgccttcagcgactac

SEQ ID NO: 10703 - DNA, 395 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgctcctactacgtcgccaccacttacttccctctcctccctcaccctctctcctacttcgccgcaaactcttcctggctagcggtacgcgtattaattgcgtcctggcctctctactgggcctgccaagggtgcgtcctaaccggcgtctgggtcatagcccacgagtgcggccaccacgccttcagcgactac

SEQ ID NO: 10704 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctggcctctctactgggccgccaagggtgcgtcctaacgggcctctgggtcatagcccacgagtgcggccaccacgccttcagcgactac

SEQ ID NO: 10705 - DNA, 268 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctcggctcctccctctaccacctctccacagcctacttccctctcccttaccacgccttcagcgactac

SEQ ID NO: 10706 - DNA, 349 bp, Artificial
  Mutation in BnaC.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 10707 - DNA, 374 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccaggcatatcttggacaagaagaagatcgctctctactgggcctgccaagggtgcgtcctaaccggcgtctgggtcatagcccacgagtgaggccaccacgccttcagcgactac

SEQ ID NO: 10708 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggatatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 10709 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 10710 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctctggcctctctactgggcctgccaagggtgcgtcctaaccggcgtctgggtcatagcccacgagtgcggccaccacgccttcagcgactac

SEQ ID NO: 10711 - DNA, 334 bp, Artificial
  Mutation in BnaC.FAD2.a introduced by TALE nuclease pair BnFAD2_T01
caggatccatgggtgcaggtggaagaatgcaagtgtctcctccatccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccactctctactgggcctgccaagggtgcgtcctaaccggcgtctgggtcatagcccacgagtgcggcaaccacgccttcagcgactac

SEQ ID NO: 10712 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggcctgccaagggtgcgtcctaaccggcgtctgggtcatagcccacgagtgcgtccaccacgccttcagcgactac

SEQ ID NO: 10713 - DNA, 355 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgacgcctggcctctctactggtcctgccaagggtgcgtcctaacgggcctctgggtcatcgcccacgaatgcggccaccacgcctcagcgactac

SEQ ID NO: 10714 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttctggcctctctactgggcctgccaagggtgcgtcctaacgggcctctgggtcatcgcccacgaatgcggccaccacgccttcagcgactac

SEQ ID NO: 10715 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccgcctggcctctctactgggcctgccaaggctgcgtcctaacgggcctctgggtcatagcccacgagtgcggccaccacgccttcagcgactac

SEQ ID NO: 10716 - DNA, 354 bp, Artificial
  Mutation in BnaC.FAD2.a introduced by TALE nuclease pair BnFAD2_T01
caggatccatgggtgcaggtgcaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccgcctggcctctctactgggcctgccaagggtgcgtcctaaccggcgtctgggtcatagcccacgagtgcggccaccacgccttcagcgactac

SEQ ID NO: 10717 - DNA, 334 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccacgagtgcggccaccacgccttcagcgactac

SEQ ID NO: 10718 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaagggtgcgtcctaaccggcgtctgggtcatagcccacgagtgcggccaccacgccttcagcgacta

SEQ ID NO: 10719 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgctagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaagggtgcgtcctaaccggcgtctgggtcatagcccacgagtgcggccaccacgccttcagcgactac

SEQ ID NO: 10720 - DNA, 349 bp, Artificial
  Mutation in BnaC.FAD2.a introduced by TALE nuclease pair BnFAD2_T01
caggatccatgggtgcatgtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctggcctctctactgggcctgccaagggtgcgtcctaaccggcgtctgggtcatagcccacgagtgcggccaccacgccttcagcgactac

SEQ ID NO: 10721 - DNA, 357 bp, Artificial
  Mutation in BnaC.FAD2.a introduced by TALE nuclease pair BnFAD2_T01
caggatccatgggtgcaggtgcaagaatgcaagtgtctcctccctccaagaagtctgaacccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctagccggcgtctgggtcatagcccacgagtgcggccaccacgccttccagcgactac

SEQ ID NO: 10722 - DNA, 350 bp, Artificial
  Mutation in BnaC.FAD2.a introduced by TALE nuclease pair BnFAD2_T01
caggatccatgggtgcaggtggaagaatgcaagtgtctccttcctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttctggcctctctactgggcctgccaagggtgcgtcctaaccggcgtctgggtcatagcccacgagtgcggccaccacgccttcagcgactac

SEQ ID NO: 10723 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactggttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgaatgcggccaccacgccttcagcgactac

SEQ ID NO: 10724 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctatcctacttctgggcctctctactgggcctgccaagggtgcgtcctaaccggcgtctgggtcatagcccacgagtgcggccaccacgccttcagcgactac

SEQ ID NO: 10725 - DNA, 339 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctctatccctcgctctttctcctacctcatctgggacatcatcatagcctcctgcttctactacgtcgccaccacttacttccctctcctccctcaccctctggcctctctactgggcctgccaaggctgcgtcctaaccggcgtctgggtcatagcccacgagtgcggccaccacgccttcagcgactac

SEQ ID NO: 10726 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgcaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgctggcccctctactgggcctgccaaggctgcgtcctaacgggcctctgggtcatcgcccacgaatgcggccaccacgccttcagcgactac

SEQ ID NO: 10727 - DNA, 334 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctgccaagggtgcgtcctaaccggcgtctgggtcatagcccacgagtgcggccaccacgccttcagcgactac

SEQ ID NO: 10728 - DNA, 344 bp, Artificial
  Mutation in BnaC.FAD2.a introduced by TALE nuclease pair BnFAD2_T01
caggatccatgggtgcaggtggaagaatgcaagtctctcctccctcaagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggccggccatgggtgcgtcctaaccggcgtctgggtcatagcccacgagtgcggccaccacgccttcagcgactac

SEQ ID NO: 10729 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggccggccaagggtgcgtcctaacgggcctctgggtcatagcccacgagtgcggccaccacgccttcagcgactac

SEQ ID NO: 10730 - DNA, 345 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaacgggcctctgggtcatagcccacgagtgcggccaccacgccttcagcgactac

SEQ ID NO: 10731 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcacctacgtctctctactgggcctgccaagggtgcgtcctaaccggcgtctgggtcatagcccacgagtgcggccaccacgccttcagcgactac

SEQ ID NO: 10732 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaacaggcgtctgggtcatagcccacgagtgcggccaccacgccttcagcgactac

SEQ ID NO: 10733 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 10734 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctctggcctctctactgggcctgccaagggtgcgtcctaaccggcgtctgggtcatagcccacgagtgcggccaccacgccatcagcgactac

SEQ ID NO: 10735 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggaactgccatggctgcgtcctaaccggcttctgggtcatagcccacgagtgcggccaccacgccttcagcgactac

SEQ ID NO: 10736 - DNA, 335 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcacctacttggcctgccaagggtgcgtcctaaccggcgtctgggtcatagcccacgagtgcggccaccacgccttcagcgactac

SEQ ID NO: 10737 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 10738 - DNA, 348 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaacgggcctctgggtcatagcccacgagtgcggccaccacgccttccgactac

SEQ ID NO: 10739 - DNA, 347 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcataggccacgagtgcggccaccacgccttcagcgactac

SEQ ID NO: 10740 - DNA, 324 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcttgccaagggtgcgtcctaaccggcgtctgggtcatagcccacgagttcggccaccacgccttcagcgactac

SEQ ID NO: 10741 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcggctgggtcatagcccacgagtgcggccaccacgccttcagcgactac

SEQ ID NO: 10742 - DNA, 349 bp, Artificial
  Mutation in BnaC.FAD2.a introduced by TALE nuclease pair BnFAD2_T01
caggatccatgggtgcaggcgcaagaatgcaagtggctcctcaatcaaagaagtctgaaaccgacaccatcaagcgcgtaccctacgagacaccgcccttcactgtaggagaactcaagaaagcaatcccaccgcactgtttcaaacgctcgatccctcgctctttctcctacctcatctggtacatcatcatagcctcctgcttctactacgtcgccaccacttacttccctctcctccctcgccctctctcctactgtggcctctctactgggcctgcctagggtgcttcctaaccgacgtctggttcatatcccagaagtgctgcctccgcgcctgcaacgactac

SEQ ID NO: 10743 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgttcgatccctcgctctttctcctacctcatctgggacatcatcatagcctcctgcttctactacgtcgccaccacttacttccctctcctccctcaccctctctcctattggcctctctactgggcctgtcaagggtgcgtcctaacgggcctctgggtcatagcccacgagtgcggccaccacgccttcagcgactac

SEQ ID NO: 10744 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaacctgcgtctgggtcatagcccacgagtgcggccaccacgccttcagcgactac

SEQ ID NO: 10745 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctgcctctctactgggcctgccaagggtgcgtcctaaccggcggctgggtcatagcccacgagtgcggccaccacgccttcagcgactac

SEQ ID NO: 10746 - DNA, 379 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaactgagcctttcgttttatctgttgtttgtcggtggcctctctactgggcctgccaaggctgcgtcctaacgggcctctgggtcatagcccacgagtgcggccaccacgccttcagcgactac

SEQ ID NO: 10747 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaagggtgcgtcctaaccggcgtctgggtcatagcccacgagtgcggccaccacgccttcagcgacta

SEQ ID NO: 10748 - DNA, 351 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcctggcctctctactgggcctgccaagggtgcgtcctaaccggcgtctgggtcatagcccacgagtgcggccaccacgccttcagcgaatac

SEQ ID NO: 10749 - DNA, 348 bp, Artificial
  Mutation in BnaC.FAD2.a introduced by TALE nuclease pair BnFAD2_T01
caggatccatgggtgcaggtgcaagaatgcaagtctctcctcactcccgctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcctctgtgtcatagcccacgagtgcggccaccacgccttcagcgactac

SEQ ID NO: 10750 - DNA, 398 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctgccaacttctcaagattgcaaaacgtggcggcgtgaccgcagtggaggcagtgcatgcgcctctctactgggcctgccaagggtgcgtcctaaccggcgtctgggtcatagcccacgagtgcggccaccacgccttcagcgactac

SEQ ID NO: 10751 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaaccggcgtctgggtcatagcccacgagtgcggccaccacgccttcagcgactac

SEQ ID NO: 10752 - DNA, 346 bp, Artificial
  Mutation in BnaC.FAD2.a introduced by TALE nuclease pair BnFAD2_T01
caggatccatgggtgcaggtgcaagaatgcaagtctctcctccctccaagaagtctgaaaccgacaccatcaagcccgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaaggctgcgtcctaacgggcctctgggtcatcgcccacgaatgcggccaccacgccttcagcgactac

SEQ ID NO: 10753 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgccctacactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 10754 - DNA, 414 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccggcaaaatcgcgccgaaggatgtcgctgccgactgggcaatggagcgcctgccggcccacctggcctctctactgggcctgccaagggtgcgtcctaaccggcgtctgggtcatagcccacgagtgcggccaccacgccttcagcgactac

SEQ ID NO: 10755 - DNA, 335 bp, Artificial
  Mutation in BnaC.FAD2.a introduced by TALE nuclease pair BnFAD2_T01
caggatccatgggtgcaggtggaagaatgcaagtgtctcctccctcaaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccaagggtgcttcctaacgggcctctgggtcatagcccacgagtgcggccaccacgccttcagcgactac

SEQ ID NO: 10756 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgatac

SEQ ID NO: 10757 - DNA, 338 bp, Artificial
  Mutation in BnaC.FAD2.a introduced by TALE nuclease pair BnFAD2_T01
caggatccatgggtgcagggggaagaatgcaagtctctcctccctccagctcccccggaaccaacaccctcaaacacgtcccctgcgagacaccaccattcactctcggacacctcaagaaagcactcccaccgcactgtttcaaacgctcgatccctcgctctttctcctacctcatctgggacatcatcatagcctcctgcttctactacgtcgccaccacttacttccctctcctccctcaccctctctcctactactgggccggccaagggtgcgtcctaaccggcgtctgggtcatagcccacgagtgcggccaccacgccttcagcgactac

SEQ ID NO: 10758 - DNA, 356 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 10759 - DNA, 347 bp, Artificial
  Mutation in BnaC.FAD2.a introduced by TALE nuclease pair BnFAD2_T01
caggatccatgggtgcaggtggaagaatgcaagtatctcctccttccaactcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgtgcctgccaagggtgcgtcctaaccgtcgtctgggtcatagcccacgagtgcggccaccacgccttcagcgactac

SEQ ID NO: 10760 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcttccaccacgccttcagcgactac

SEQ ID NO: 10761 - DNA, 348 bp, Artificial
  Mutation in BnaC.FAD2.a introduced by TALE nuclease pair BnFAD2_T01
caggatccatgggtgcaggtggaagaatgcaagtgtctactccctcaaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccgcctggcctctctactgggccggccatgggtgcgtcctaaccggcgtctgggtcatatcccacgagtgcggccaccacgccttcagcgactac

SEQ ID NO: 10762 - DNA, 346 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 10763 - DNA, 332 bp, Artificial
  Mutation in BnaC.FAD2.a introduced by TALE nuclease pair BnFAD2_T01
caggatccatgggtgcaggtggaagaatgcaagtgactcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccacctcttacttccctctcctccctcaccctctctcctgggcctgccaagggtgcgtcctaaccggcgtctggttcatagcccacgagtgcggccaccacgccttcagcgactac

SEQ ID NO: 10764 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctctcaactgggcctgccaagggtgcgtcctaaccggcgtctgggtcatagcccacgagtgcggccaccacgccttcagcgactac

SEQ ID NO: 10765 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctgccaaggctgcgtcctaacgggcctctgggtcatagcccacgagtgcggccaccacgccttcagcgactac

SEQ ID NO: 10766 - DNA, 389 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccacccacgtataaaccgtcgatgccctgctgaatattgaactgacccaggcgactggcctctctactgggccggccaagggtgcgtcctaacgggcctctgggtcatcgcccacgaatgcggccaccacgccttcagcgactac

SEQ ID NO: 10767 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcgcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccacgcctctctaccgggcctgccaagggtgcgtcctaaccggcgtctgggtcatagcccacgagtgcggccaccacgccttcagcgactac

SEQ ID NO: 10768 - DNA, 324 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctcttgccaagggtgcgtcctaaccggcgtctgggtcatagcccacgagtgcggccaccacgccttcagcgactac

SEQ ID NO: 10769 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgcctgcagcgactac

SEQ ID NO: 10770 - DNA, 339 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccaagggtgcgtcctaaccggcgtctgggtcatagcccacgagtgcggccaccacgccttcagcgactac

SEQ ID NO: 10771 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtccccacaccctacttccctctcctccccccccccctcccttacctggcccctctactgggcctgccaaggctgcgtcctaacgggcctctgggtcatcgcccacgaatgcggccaccacgccttcagcgactac

SEQ ID NO: 10772 - DNA, 348 bp, Artificial
  Mutation in BnaC.FAD2.a introduced by TALE nuclease pair BnFAD2_T01
caggatccatgggtgcagggggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactggtcctgccaagggtgcgtcctaaccggcgtctgggtcatagcccacgagggtggccaccacgccttcagcgactac

SEQ ID NO: 10773 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagggcggccaccacgccttcagcgactac

SEQ ID NO: 10774 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcatgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 10775 - DNA, 338 bp, Artificial
  Mutation in BnaC.FAD2.a introduced by TALE nuclease pair BnFAD2_T01
caggatccatgggtgcaggtggaagaatgcaagtctctactccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcccgccaagggtgcgtcctaaccggcgtctgggtcatagcccacgagtgcggccaccacgccttcagcgactac

SEQ ID NO: 10776 - DNA, 390 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaattccaccgcactgtttcaaacgctcgatccctcgctctttctcctacctcatctgggacatcatcatagcctcctgcttctactacgtcgccaccacttacttccctctcctccctcaccctctctcctacttgctggcgatgaccaccacctgctggggggtcaagccgtgggcggcctctctactgggcctgccaagggtgcgtcctaaccggcgtctgggtcatagcccacgagtgcggccaccacgccttcagcgactac

SEQ ID NO: 10777 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctacgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 10778 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcggcccctctactgggcctgccaaggctgcgtcctaacgggcctctgggtcatagcccacgagtgcggccaccacgccttcagcgactac

SEQ ID NO: 10779 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggtgcgtcctaaccggcgtctgggtcatagcccacgagtgcggccaccacgccttcagcgactac

SEQ ID NO: 10780 - DNA, 383 bp, Artificial
  Mutation in BnaC.FAD2.a introduced by TALE nuclease pair BnFAD2_T01
caggatccatgggtgcaggtggaagaatgcaagtgtcacctccctccaagaagtctgaaaccgacaccataaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcagctgctgttgccggtgctgtgccaggcccacgtcttctctctactgggcctgccaagggtgcgtccgaaccggcgtctgggtcatagcccacgagtgcggccaccacgccttcagcgactac

SEQ ID NO: 10781 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaacgggcctctgggtcatagcccacgagtgcggccaccacgccttcagcgactac

SEQ ID NO: 10782 - DNA, 393 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccaacggtgcaggcgctgttgccggtgctgtgccaggcccacggcttgacccctggcctctctactgggcctgccaagggtgcgtcctaaccggcgtctgggtcatagcccacgagtgcggccaccacgccttcagcgactac

SEQ ID NO: 10783 - DNA, 390 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcggtggcaagcacctgctggggggtcaagccgtggtcggcctctctactgggcctgccaagggtgcgtcctaaccggcgtctgggtcatagcccacgagtgcggccaccacgccttcagcgactac

SEQ ID NO: 10784 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaagggtgcgtcctaaccggcgtctgggtcatagcccacgagtgcggccaccacgccttcagcgactac

SEQ ID NO: 10785 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtggcctctctactgggcctgccaagggtgcgtcctaaccggcgtctgggtcatagcccacgagtgcggccaccacgccttcagcgactac

SEQ ID NO: 10786 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatcgcccacgaatgcggccaccacgccttcagcgactac

SEQ ID NO: 10787 - DNA, 348 bp, Artificial
  Mutation in BnaC.FAD2.a introduced by TALE nuclease pair BnFAD2_T01
caggatccatgggtgcaggtggaagaatgcaagtctctcctccctccaagaagtctgaaacctacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 10788 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccgccggcctctctactgggcctgccaagggtgcgtcctaaccggcgtctgggtcatagcccacgagtgcggccaccacgccttcagcgactac

SEQ ID NO: 10789 - DNA, 334 bp, Artificial
  Mutation in BnaC.FAD2.a introduced by TALE nuclease pair BnFAD2_T01
caggatccatgggtgcaggtggaagaatgcaagtgtctactcactccaagaagtctgaaaccgacaccatcaagcgcgtaccctgcgagacaccgcccttcactgtcggagaactcaagaaagcaatcccaccgcactgtttcaaacgctcgatccctcgctctttctcatacctcatctgggacatcatcatagcctcctgcttctactacgtcgccaccacttacttccctctcctccctcaccctctctctactgggcctgccaagggtgcgtcctaaccggcgtcttggtcatatcccacgagtgcggccaccacgccttcagcgactac

SEQ ID NO: 10790 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcatgcttctactacgtcgccaccacttacttccctctcctccctcaccctctcccctccttcgccgcctggcctctctactgggcctgccaagggtgcgtcctaaccggcgtctgggtcatagcccacgagtgcggccaccacgccttcagcgactac

SEQ ID NO: 10791 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctctggcctctctactgggcctgccaagggtgcgtcctagccggcgtctgggtcatagcccacgagtgcggccaccacgccttcagcgactac

SEQ ID NO: 10792 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttacctctcctccctcaccctctctcctacttgcctctctactgggcctgccaagggtgcgtcctaacgggcctctgggtcatagcccacgagtgcggccaccacgccttcagcgactac

SEQ ID NO: 10793 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgcaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaaccggcgtctgggtcatagcccacgagtgcggccaccacgccttcagcgactac

SEQ ID NO: 10794 - DNA, 352 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcgcctggcctctctactgggcctgccaagggtgcgtcctaaccggcgtctgggtcatagcccacgagtgcggccaccacgccttcagcgactac

SEQ ID NO: 10795 - DNA, 324 bp, Artificial
  Mutation in BnaC.FAD2.a introduced by TALE nuclease pair BnFAD2_T01
caggatccatgggtgcaggtggaagaatgcaagtgactcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcgccaagggtgcgtcctaaccggcgtctgggtcatagcccacgagtgcggccaccacgccttcagcgactac

SEQ ID NO: 10796 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacgtcgcctctctactgggcctgccaagggtgcgtcctaacaggagtctgggtcatagcccacgattgcggccaccacgccttcagcgactac

SEQ ID NO: 10797 - DNA, 350 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgagtcatagcccacgagtgcggccaccacgccttcagcgactac

SEQ ID NO: 10798 - DNA, 350 bp, Artificial
  Mutation in BnaC.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttccggcctctctactgggcctgccaagggtgcgtcctaaccggcgtctgggtcatagcccacgagtgcggccaccacgccttcagcgactac

SEQ ID NO: 10799 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccaagggtgcgtcctaaccggcgtctgggtcatagcccacgagtgcggccaccacgccttcagcgactac

SEQ ID NO: 10800 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttgcctctctactgggcctgccaagggtgcgtcctaaccggcttctgggtcatagcccacgagtgcggccaccacgccttcagcgactac

SEQ ID NO: 10801 - DNA, 348 bp, Artificial
  Mutation in BnaC.FAD2.a introduced by TALE nuclease pair BnFAD2_T01
caggatccatgggtgcaggtggaagaatgcaagtgtctcatgcctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccctggcctctctactgggcctgccaagggtgcgtcctaaccggcgtctgggtcatagcccacgagtgcgtccaccacgccttcagcgactac

SEQ ID NO: 10802 - DNA, 379 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaactgagcctttcgttttatctgttgtttgtcggtggcctctctactgggcctgccaagggtgcgtcctaaccggcgtctgggtcatagcccacgagtgcggccaccacgccttcagcgactac

SEQ ID NO: 10803 - DNA, 339 bp, Artificial
  Mutation in BnaC.FAD2.a introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgggtcatagcccacgagtgcggccaccacgccttcagcgactac

SEQ ID NO: 10804 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 10805 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaacctacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgagtgcggccaccacgccttcagcgactac

SEQ ID NO: 10806 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcctccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtcttggtcatagcccacgagtgcggccaccacgccttcagcgactac

SEQ ID NO: 10807 - DNA, 331 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgggcctgccaagggtgcgtcctaaccggcgtctgggtcatagcccacgagtgcggccaccacgccttcagcgactac

SEQ ID NO: 10808 - DNA, 350 bp, Artificial
  Mutation in BnaC.FAD2.a introduced by TALE nuclease pair BnFAD2_T01
caggatccatgggtgcaggtggaataatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 10809 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctattggcctctctactgggcctgccaagggtgcgtcctaaccggcgtctgggtcatagcccacgagtgcggccaccacgccttcagcgactac

SEQ ID NO: 10810 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctcaccggcgtctgggtcatagcccacgagtgcggcctccacgccatcagcgactac

SEQ ID NO: 10811 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgctccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactcc

SEQ ID NO: 10812 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccgtgggcctctatacggggcctgccaagggtgcgtcctaaccggcgtctgggtcatagcccacgagtgcggccaccacgccttcagcgactac

SEQ ID NO: 10813 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacgtcgcctctctactgggcctgccaagggtgcgtcctaaccggcgtctgggtcatagcccacgagtgcggccaccacgccttcagcgactac

SEQ ID NO: 10814 - DNA, 405 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcaatgcactgacgggtgccccgctcaacttgaccccccagcaggtggtggccatcggcctctctactgggcctgccaagggtgcgtcctaacgggcctctgggtcatagcccacgagtgcggccaccacgccttcagccactac

SEQ ID NO: 10815 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgtggccaccacgccttcagcgactac

SEQ ID NO: 10816 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatcccccgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 10817 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgtgcctgccaagggttcgtcctaaccggcgtctgggtcatagcccacgagtgcggccaccacgccttcagcgactac

SEQ ID NO: 10818 - DNA, 345 bp, Artificial
  Mutation in BnaC.FAD2.a introduced by TALE nuclease pair BnFAD2_T01
caggatccatgggtgcaggtggaagaatgcaagtgtctcctccctcaaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttctctctactgggcctgccaagggtgcgtcctaaccggcgtctgggtcatagcccacgagtgcggccaccacgcctacagcgactac

SEQ ID NO: 10819 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttctggcctctctactgggcctgccaagggggcgtcctaaccggcgtctgggtcatagcccacgggtgcggccaccacgccttcagcactac

SEQ ID NO: 10820 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgggcctctctactgggcctgccaagggtgcgtcctagccggcgtctgggtcatagcccacgagggcggccaccacgccttcagcgactac

SEQ ID NO: 10821 - DNA, 300 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtctctctactgggcctgccaagggtgcgtcctaaccggcgtctgggtcatagcccacgagtgcggccaccacgccttcagcgactac

SEQ ID NO: 10822 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcgcccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctccttctcctggcctctctactgggcctgccaaggctgcgtcctaacgggcctctgggtcatagcccacgagtgcggccaccacgccttcagcgactac

SEQ ID NO: 10823 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctctttctcctacctcatctgggacatcatcatagcctcctgcttctactacgtcgccaccacttacttccctctcctccctcaccctctctcctacttcgcctttggcctctctactgggcctgccaagggtgcgtcctaaccggcgtctgggtcatagcccacgagtgcggccaccacgccttcagcgactac

SEQ ID NO: 10824 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 10825 - DNA, 349 bp, Artificial
  Mutation in BnaC.FAD2.a introduced by TALE nuclease pair BnFAD2_T01
caggatccatgggtgcaggtggaagaatgcaagtgactcctctctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgggcctctctactgggcctgccgagggtgcgtccgaaccggcgtctgggtcatagcccacgagggtggccaccacgccttcagcgactac

SEQ ID NO: 10826 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 10827 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccctggcctctctactgggcctgccaagggtgcgtcctaaccggcgtctgggtcatagcccacgagtgcggccaccacgccttcagcgactac

SEQ ID NO: 10828 - DNA, 318 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccaaggctgcgtcctaacgggcctctgggtcatagcccacgagtgcggccaccacgccttcagcgactac

SEQ ID NO: 10829 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 10830 - DNA, 323 bp, Artificial
  Mutation in BnaC.FAD2.a introduced by TALE nuclease pair BnFAD2_T01
caggatccatgggtgcaggtgcaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagggtgcgtcctaaccggcgtctgggtcatagcccacgagtgcggccaccacgccttcagcgactac

SEQ ID NO: 10831 - DNA, 342 bp, Artificial
  Mutation in BnaC.FAD2.a introduced by TALE nuclease pair BnFAD2_T01
caggatccatgggtgcaggtggaagaatgcaagtgcctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgcctctctactgggcctgccaagggtgcgtcctaaccggcgtctgggtcatagcccacgagtgcggccaccacgccttcagcgactac

SEQ ID NO: 10832 - DNA, 351 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccaagggtgcgtcctaaccggcgtctgggtcatagcccacgagtgcggccaccacgccttcagcgactac

SEQ ID NO: 10833 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctccttctcctctctacggggcctgccaagcctgcgtcctaacgggcctctgggtcatagcccacgagtgcggccaccacgccttcagcgactac

SEQ ID NO: 10834 - DNA, 350 bp, Artificial
  Mutation in BnaC.FAD2.a introduced by TALE nuclease pair BnFAD2_T01
caggatccatgggtgcaggtggaagaatgcaagtgcctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagttcggccaccacgccttcagcgactac

SEQ ID NO: 10835 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccacaacgcctgcagcgactac

SEQ ID NO: 10836 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccaagggtgcgtcctaacgggcctctgggtcatagcccacgagtgcggccaccacgccttcagcgactac

SEQ ID NO: 10837 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagtgactac

SEQ ID NO: 10838 - DNA, 347 bp, Artificial
  Mutation in BnaC.FAD2.a introduced by TALE nuclease pair BnFAD2_T01
caggatccatgggtgcaggtggaagaatgcaagtctctcgtccctccagctcccccggaaccaacacactcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcaactac

SEQ ID NO: 10839 - DNA, 346 bp, Artificial
  Mutation in BnaC.FAD2.a introduced by TALE nuclease pair BnFAD2_T01
caggatccatgggtgcaggtggaagaatgcaagtgtctcctccatccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccatctcctccctcaccctctctcctactgcctctctactgggcctgccaagggtgcgtcctaaccggcgtctgggtcatagcccacgagtgcggccaccacgccttcagcgactac

SEQ ID NO: 10840 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgagcctgccaaggctgcgtcctgacgggcctctgggtcatcgcccacgaatgcggccaccacgccttcagcgactac

SEQ ID NO: 10841 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagggcggccaccacgccttcagcgactac

SEQ ID NO: 10842 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccccttacttccccctcctccctcaccctctctcctcctggcctctctactgggcctgccaaggctgcgtcctaacgggcctctgggtcatagcccacgagtgcggccaccacgccttcagcgactac

SEQ ID NO: 10843 - DNA, 318 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccaagggtgcgtcctaacgggcctctgggtcatagcccacgagtgcggccaccacgccttcagcgactac

SEQ ID NO: 10844 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgactggcctctcaactgggcctgccaagggtgcgtcctaaccggcgactgggtcatagcccacgagtgcggccaccacgccttcagcgactac

SEQ ID NO: 10845 - DNA, 385 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccgtgggcctggcacaccaccggcaacagccgctggaccgtctccagcgcctgcctggcctctctactgggcctgccaagggttcgtcctaaccggcgtctgggtcatagcccacgagtgcggccaccacgccttcagcgactac

SEQ ID NO: 10846 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgtgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 10847 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccggcctctctactgggcctgccaaggctgcgtcctaacgggcctctgggtcatagcccacgagtgcggccaccacgccttcagcgactac

SEQ ID NO: 10848 - DNA, 340 bp, Artificial
  Mutation in BnaC.FAD2.a introduced by TALE nuclease pair BnFAD2_T01
caggatccatgggtgcaggtggaagaatgcaagtctctcctccctccagctccccaggaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccaaggctgcgtcctaacgggcctctgggtcatagcccacgagtgcggccaccacgccttcagcgactac

SEQ ID NO: 10849 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgagtgcggccaccacgccttcagcgactac

SEQ ID NO: 10850 - DNA, 351 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaaccggcgtctgggtcatagcccacgagtgcggccaccacgccttcagcgactac

SEQ ID NO: 10851 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttacctctcctccctcaccctctctcctactggcctctctactgggcctgccaagggtgcgtcctaaccggcgtctgggtcatagcccacgagtgcggccaccacgccttcagcgactac

SEQ ID NO: 10852 - DNA, 350 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaacgggcctctgggtcatagcccacgagtgcggccaccacgccttcagcgactac

SEQ ID NO: 10853 - DNA, 348 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttcgcctctctactgggcctgccaagggtgcgtcctaaccggcgtctgggtcatagcccacgagtgcggccaccacgccttcagcgactac

SEQ ID NO: 10854 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 10855 - DNA, 462 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctcctcccgcgttgaccaacgaccccctcgtcgccttggcctgcctcggcgggcgtcctgcgctggatgcagtgaaaaagggattgggggatcctatcagccgttcccagctggacgcctggcctctctactgggcctgccaagggtgcgtcctaaccggcgtctgggtcatagcccacgagtgcggccaccacgccttcagcgactac

SEQ ID NO: 10856 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccgcttacttctctctccgccctcaccctctctcctacatggcctctctactgggcctgccaagggtgcgtcctaaccggcgtctgggtcatagcccacgaaggcggccaccacgccttcagcgactac

SEQ ID NO: 10857 - DNA, 349 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctcccaagggtgcgtcctaaccggcgtctgggtcatagcccacgagtgcggccaccacgccttcagcgactac

SEQ ID NO: 10858 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagactcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 10859 - DNA, 324 bp, Artificial
  Mutation in BnaC.FAD2.a introduced by TALE nuclease pair BnFAD2_T01
caggatccatgggtgcaggtggaagaatgcaagtctctcctccctccagctcccccggaaccaaaaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcaccaagggtgcgtcctaaccggcgtctgggtcatagcccacgagtgcggccaccacgccttcagcgactac

SEQ ID NO: 10860 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactctctactgggcctgccaaggctgcgtcctaacgggcctctgggtcatcgcccacgaatgcggccaccacgccttcagcgactac

SEQ ID NO: 10861 - DNA, 277 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccacgccttcagcgactac

SEQ ID NO: 10862 - DNA, 347 bp, Artificial
  Mutation in BnaC.FAD2.a introduced by TALE nuclease pair BnFAD2_T01
caggatccatgggtgcaggtggaagaatgcaagtctctcctccctccagctccccgaaaacaaaaacctcaaaagcgtcccctgcgagacaccacccttcactctcggagacctcaagaaagcaatcccaacgcactgtttcaaacgctcgatccctcgctctttctcctacctcatctgggacatcatcatagccccctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 10863 - DNA, 342 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaagggtgcgtcctaaccggcgtctgggtcatagcccacgagtgcggccaccacgccttcagcgactac

SEQ ID NO: 10864 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactggtcctgccaagggtgcgtcctaaccggcgtctgggtcatagcccacgagtgcggccaccacgccttcagcgactac

SEQ ID NO: 10865 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtcctaaccggcgtctgggtcatagcccacgagtgcggccaccacgccttcagcgactac

SEQ ID NO: 10866 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaagggtgcgtcctaaccggcgtctgggtcatagcccacgaatgcggccaccacgccttcagcgactac

SEQ ID NO: 10867 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgcccttcagcgactac

SEQ ID NO: 10868 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 10869 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgctagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 10870 - DNA, 349 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgaatgcggccaccacgccttcagcgactac

SEQ ID NO: 10871 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcgtagacctcaagaaagcaatcccacctcactgcttcaaacgctccatccctcgctccttctcctacctcatctgggacatcatcatagcctcctgcttctactacgtcgccaccacttacttccctcgcctccctcaccctctctcctactctggcctctctactggacctgccaagggtgcgtcctaacgggcctctgggtcatagcccacgagtgcggccaccacgccatcagcgactac

SEQ ID NO: 10872 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctggaactgccaagggtgcgtcctaaccggcgtctgggtcatagcccacgagtgcggccaccacgccttcagcgactac

SEQ ID NO: 10873 - DNA, 347 bp, Artificial
  Mutation in BnaC.FAD2.a introduced by TALE nuclease pair BnFAD2_T01
caggatccatgggtgcaggtggaaggatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctcctctctactgggcctgccaagggtgcgtcctaacgggcctctgggtcatcgcccacgaaggtggccaccacgccttcagcgactac

SEQ ID NO: 10874 - DNA, 349 bp, Artificial
  Mutation in BnaC.FAD2.a introduced by TALE nuclease pair BnFAD2_T01
caggatcatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 10875 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaacgggcctctgggtcatcgcccacgaatgcggccaccacgccttcagcgactac

SEQ ID NO: 10876 - DNA, 346 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcctctgggtcatagcccacgagtgcggccaccacgccttcagcgactac

SEQ ID NO: 10877 - DNA, 352 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccaagggtgcgtcctaacgggcctctgggtcatagcccacgagtgcggccaccacgccttcagcgactac

SEQ ID NO: 10878 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggtctgccaagggtgcgtcctaaccggcgtctgggtcatagcccacgagtgcggccaccacgccttcagcgactac

SEQ ID NO: 10879 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaacctacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatggcctctctactgggcctgccaagggtgcgtcctaaccggcgtctgggtcatagcccacgagtgcggccaccacgccttcagcgactac

SEQ ID NO: 10880 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgggcctctctactgggcctgccaagggtgcgtcctaacgggcctctgggtcatcgcccacgaatgcggccaccacgccttcagcgactac

SEQ ID NO: 10881 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgcctccacttacttccctctcctccctcaccctctctcctccgtggcctctctactgggcctgccaagggtgcgtcctaaccggcgtctgggtcatagcccacgagtgcggccaccacgccttcagcgactac

SEQ ID NO: 10882 - DNA, 354 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccaagggtgcgtcctaaccggcgtctgggtcatagcccacgagtgcggccaccacgccttcagcgactac

SEQ ID NO: 10883 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgtggcctctctactgggcctgccaagggtgcgtcctaacgggcctctgggtcatcgcccacgaatgcggccaccacgccttcagcgactac

SEQ ID NO: 10884 - DNA, 348 bp, Artificial
  Mutation in BnaC.FAD2.a introduced by TALE nuclease pair BnFAD2_T01
caggatccatgggtgcaggtgcaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 10885 - DNA, 349 bp, Artificial
  Mutation in BnaC.FAD2.a introduced by TALE nuclease pair BnFAD2_T01
caggatccatgggtgcaggtggaagaatgcaagtctctcctccctccagctccccggaaccaacaccctcaaacgcgtcccctgcgagacaccaccattcactctcggagacctcaagaaagcaatcccaccgcactgtttcaaacgctcgacccctcgctctttctcctacctcatctgcgacatcatcatagcctcctgcttctactacgtcgccaccacttacttccctctcctccctcaccctctctcctacttcctggcctctctactgggcctgccaagggtgcgtcctaaccggcgtctgggtcatagcccacgagtgcggccaccacgcctcagcgactac

SEQ ID NO: 10886 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctatcctcctttggcctctctactgggcctgccaagggtgcgtcctaaccggcgtctgggtcatagcccacgagtgcggccaccacgccttcagcgactac

SEQ ID NO: 10887 - DNA, 332 bp, Artificial
  Mutation in BnaC.FAD2.a introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaaccggcgtctgggtcatagcccacgagtgcggccaccacgccttcagcgactac

SEQ ID NO: 10888 - DNA, 393 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctaacggtgcaggcgctgttgccggtgctgtgccaggcccacggcttgacccctggcctctctactgggtctgccaagggtgcgtcctaacctgcgtctgggtcatagcccacgagtgcggccaccacgccatcagcgactac

SEQ ID NO: 10889 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacatcgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaaccggcgtctgggtcatagcccacgagtgcggccaccacgccttcagcgactac

SEQ ID NO: 10890 - DNA, 357 bp, Artificial
  Mutation in BnaC.FAD2.a introduced by TALE nuclease pair BnFAD2_T01
caggatccatgggtgcaggtggaagaatgcaagtctctacaccctccagctcccccggaaccaacaccctcaaacgcgtaccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggtgcctggcctctctactgggcctgccaagggtgcgtcctaaccggcgtctgggtcatagcccacgagtgcggccaccacgccttcagcgactac

SEQ ID NO: 10891 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttcgcctggcctctctactgggcctgccaagggtgcgtcctaaccggcgtctgggtcatagcccacgagtgcggccaccacgccttcagcgactac

SEQ ID NO: 10892 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgctgggcctctctactgggcctgccaagggtgcgtcctatccggcgtctgggtcatagcccacgagtgcggccaccacgccttcagcgactac

SEQ ID NO: 10893 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttggcctctctactgggcctgccaagggtgcgtcctaaccggcgtctgggtcatagcccacgagtgcggccaccacgccttcagcgactac

SEQ ID NO: 10894 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctcctttggcctctctactgggcctgccaagggtgcgtcctaaccggcgtctgggtcatagcccacgaatgcggccaccacgccttcagcgactac

SEQ ID NO: 10895 - DNA, 385 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccgtgggcctgccaccgccccggcaccagccgctggaccgtctccagcgcctgcctggcctctctactgggcctgccaatggtgcgtcctaaccggcgtctgggtcatagcccacgagtgcggccaccacgccttcagcgactac

SEQ ID NO: 10896 - DNA, 358 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctaccctggcctctctactgggcctgccaagggtgcgtcctaaccggcgtctgggtcatagcccacgagtgcggccaccacgccttcagcgactac

SEQ ID NO: 10897 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggaaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 10898 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaaggctgcgtcctaacgggcctctgggtcatagcccacgagtgcggccaccacgccttcagcgactac

SEQ ID NO: 10899 - DNA, 349 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccgcgagtgcggccaccacgccttcagcgactac

SEQ ID NO: 10900 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccaagggtgcgtcctaaccggcgtctgggtcatagcccacgagtgcggccaccacgccttcagcgactac

SEQ ID NO: 10901 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtcttggtcatagcccacgagtgcggccaccacgccttcagcgactac

SEQ ID NO: 10902 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctagctctttctcctacctcatctgggacatcatcatagcctcctgcttctactacgtcgccaccacttacttccctctcctccctcaccctctctcctcctccccccgcctggcctctctactgggcctgccaagggtgcgtcctaaccggcgtctgggtcatagcccacgagtgcggccaccacgccttcagcgactac

SEQ ID NO: 10903 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccccccctctcccttccctcgcctctactgggcctgccaaggctgcgtcctaacgggcctctgggtcatcgcccacgaatgcggccaccacgccttcagcgactac

SEQ ID NO: 10904 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcggctctctactgggcctgccaagggtgcgtcctaaccggcgtctgggtcatagcccacgaatgcggccaccacgccttcagcgactac

SEQ ID NO: 10905 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgtgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcggctgggtcatagcccacgagtgcggccaccacgccttcagcgactac

SEQ ID NO: 10906 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcctctgggtcatagcccacgagtgcggccaccacgccttcagcgactac

SEQ ID NO: 10907 - DNA, 378 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcgctgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgctttggtccggttccggaacaggagcgatgggagggcctctctactgggcctgccaagggggcgtcctgacgggcctctgggtcatcgcccacgaatgcggccaccacgccttcagcgactac

SEQ ID NO: 10908 - DNA, 441 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggtggccatcgccagccacgatagcggcaagcaggcgctggagacggtccagcggctgttgccggtgctgtgccaggcccacggcttgacccctggcctctctactgggcctgccaagggtgcgtcctaaccggcgtctgggtcatagcccacgagtgcggccaccacgccttcagcgactac

SEQ ID NO: 10909 - DNA, 344 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 10910 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactacc

SEQ ID NO: 10911 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctgcctctctactgggcctgccaagggtgcgtcctaacgggcctctgggtcatcgcccacgaatgtggccaccacgccttcagcgactac

SEQ ID NO: 10912 - DNA, 349 bp, Artificial
  Mutation in BnaC.FAD2.a introduced by TALE nuclease pair BnFAD2_T01
caggatccatgggtgcaggtggaagaatgcaagtgtctcccccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 10913 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctagccggcgtctgggtcatagcccacgagtgcggccaccacgccttcagcgactac

SEQ ID NO: 10914 - DNA, 351 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcctctctactgggcctgccaagggtgcgtcctaaccggcgtctgggtcatagcccacgagtgcggccaccacgccttcagcgactac

SEQ ID NO: 10915 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaacgggcctctgggtcatagcccacgagtgcggccaccacgccttcagcgactac

SEQ ID NO: 10916 - DNA, 346 bp, Artificial
  Mutation in BnaC.FAD2.a introduced by TALE nuclease pair BnFAD2_T01
caggatccatgtgtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 10917 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactggtcctgccaagggtgcgtcctaaccggcgtctgggtcatagcccacgagtgcggccaccacgccttcagcgactac

SEQ ID NO: 10918 - DNA, 277 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccaccaagcgcgtaccctgcgagacaccgcccttcactgtcggagaactcaagaaagcaatcccaccgcactgtttcaaacgctcgatccctcgctccttctcctacctcatctgggacatcatcatagcctcctgcttctactacgtcgccaccacttactaccctctcctccctcaccctctctcctacttcacgccttcagcgactac

SEQ ID NO: 10919 - DNA, 351 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgggcctctctactgggcctgccaagggtgcgtcctaaccggcgtctgggtcatagcccacgagtgcggccaccacgccttcagcgactac

SEQ ID NO: 10920 - DNA, 356 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaacgggcctctgggtcatagcccacgagtgcggccaccacgccttcagcgactac

SEQ ID NO: 10921 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatcccccgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 10922 - DNA, 318 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttggcaggcctctctactgggcctgccaagggtgcgtcctaaccggcgtctgggtcatagcccacgagtgcggccaccacgccttcagcgactac

SEQ ID NO: 10923 - DNA, 339 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgccctaaccggcgtctgggtcatagcccacgagtgcggccaccacgccttcagcgactac

SEQ ID NO: 10924 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaatggcctctctactgggcctgccaaggctgcgtcctaacgggcctctgggtcatcgcccacgaatgcggccaccacgccttcagcgactac

SEQ ID NO: 10925 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgtggccaccacgccttcagcgacgac

SEQ ID NO: 10926 - DNA, 338 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctctctctactgggcctgccaagggtgcgtcctaaccggcgtctgggtcatagcccacgagtgcggccaccacgccttcagcgactac

SEQ ID NO: 10927 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctaggcctctctactgggcctgccaagggtgcgtcctaaccggcgtctgggtcatagcccacgagtgcggccaccacgccttcagcgactac

SEQ ID NO: 10928 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtacgtcctaaccggcgtctgggtcatagcccacgagtgcggccaccacgccttcagcgactac

SEQ ID NO: 10929 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccctactttggcctctctactgggcctgccaagggtgcgtcctaaccggcgtctgggtcatagcccacgagtgcggccaccacgccttcagcgactac

SEQ ID NO: 10930 - DNA, 348 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaacatcaagcgcgtaccctgcgagacaccgccgttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccccttggcctctctactgggcctgccaagggtgcgtcctaaccggcgtctgggtcatagcccacgagtgcggccaccacgccttcagcgactac

SEQ ID NO: 10931 - DNA, 329 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttctgccaagggtgcgtcctaaccggcgtctgggtcatagcccacgagtgcggccaccacgccttcagcgactac

SEQ ID NO: 10932 - DNA, 351 bp, Artificial
  Mutation in BnaC.FAD2.a introduced by TALE nuclease pair BnFAD2_T01
caggatccatgggtgcaggtggaagaatgcaagtgtcacccaactccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggggcctatctactgggcctgccaagggtgcgtcctaaccggcgtctgggtcatagcccacgagtgcggccaccacgccttcagcgactac

SEQ ID NO: 10933 - DNA, 348 bp, Artificial
  Mutation in BnaC.FAD2.a introduced by TALE nuclease pair BnFAD2_T01
caggatccatgggtgcaggtgaaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctcaactgggcctgccaagggtgcgtcctaaccggcgtctgggtcatagcccacgagtgcggccaccacgccttcagcgactac

SEQ ID NO: 10934 - DNA, 348 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccgcctggcctctctactgggcctgccaagggtgcgtcctaaccggcgtctgggtcatagcccacgagtgcggccaccacgccttcagcgactac

SEQ ID NO: 10935 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgaatgcggccaccacgccttcagcgactac

SEQ ID NO: 10936 - DNA, 349 bp, Artificial
  Mutation in BnaC.FAD2.a introduced by TALE nuclease pair BnFAD2_T01
caggatccatgtgtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 10937 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctagcctggcctctctactgggcctgccaagggtgcgtcctaaccggcgtctgggtcatagcccacgagtgtggccaccacgccttcagcgactac

SEQ ID NO: 10938 - DNA, 334 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccacgagtgcggccaccacgccttcagcgactac

SEQ ID NO: 10939 - DNA, 337 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgcttcaaacgctcgatccctcgctctttctcctacctcatctgggacatcatcacagcctcctgcttctactacgtccccaccacttacttccctcccctccctccccctctctcctctactgggcctgccaagggtgcgtcctaaccggcgtctgggtcatagcccacgagtgcggccaccacgccttcagcgactac

SEQ ID NO: 10940 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccacttggcctctctactgggcctgccaagggtgcgtcctaaccggcgtctgggtcatagcccacgagtgcggccaccacgccttcagcgactac

SEQ ID NO: 10941 - DNA, 346 bp, Artificial
  Mutation in BnaC.FAD2.a introduced by TALE nuclease pair BnFAD2_T01
caggatccatgggtgcaggtagaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaaccggcgtctgggtcatagcccacgagtgcggccaccacgccttcagcgactac

SEQ ID NO: 10942 - DNA, 349 bp, Artificial
  Mutation in BnaC.FAD2.a introduced by TALE nuclease pair BnFAD2_T01
caggatccatgggtgcaggtggaagaatgcaagtgtatactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 10943 - DNA, 351 bp, Artificial
  Mutation in BnaC.FAD2.a introduced by TALE nuclease pair BnFAD2_T01
caggatccatgggtgcaggtgggagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggggcctctctactgggcctgccaagggtgcgtcctaaccggcgtctgggtcatagcccacgagtgcggccaccacgccttcagcgactac

SEQ ID NO: 10944 - DNA, 349 bp, Artificial
  Mutation in BnaC.FAD2.a introduced by TALE nuclease pair BnFAD2_T01
caggatccatgggtgcaggtagaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgagcctgccaagggtgcgtcctaaccggcgtctgggtcatagcccacgagtgcggccaccacgccttcagcgactac

SEQ ID NO: 10945 - DNA, 345 bp, Artificial
  Mutation in BnaC.FAD2.a introduced by TALE nuclease pair BnFAD2_T01
caggatccatgggtgcaggtgaaagaatgcaagtggctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacgtctctctactgggcctgccaagggtgcgtcctaaccggcgtctgggtcacagcccacgagtgcggccaccacgccatcagcgactac

SEQ ID NO: 10946 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcaaagcccacgagtgcggccaccacgccttcagcgactac

SEQ ID NO: 10947 - DNA, 355 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccttgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctcctgggcatgccaagggtgcgtcttgaccggcgtctgtgtcattgcccacgagtgcggccaccacgccttcatcgactac

SEQ ID NO: 10948 - DNA, 358 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctaaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctcgcctggcctctctactgggcctgccaagggtgcgtcctaaccggcgtctgggtcatagcccacgagtgcggccaccacgccttcagcgactac

SEQ ID NO: 10949 - DNA, 325 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctctcctacttggctgcgtcctaaccggcgtctgggtcatagcccacgagtgcggccaccacgccttcagcgactac

SEQ ID NO: 10950 - DNA, 346 bp, Artificial
  Mutation in BnaC.FAD2.a introduced by TALE nuclease pair BnFAD2_T01
caggatccatgggtgcaggtgcaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaaccggcgtctgggtcatagcccacgagtgcggccaccacgccttcagcgactac

SEQ ID NO: 10951 - DNA, 348 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagttcggccaccacgccttcagcgactac

SEQ ID NO: 10952 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaaggctgcgtcctaaccggcgtctgggtcatagcccacgagtgcggccaccacgccttcagcgactac

SEQ ID NO: 10953 - DNA, 347 bp, Artificial
  Mutation in BnaC.FAD2.a introduced by TALE nuclease pair BnFAD2_T01
caggatccatgggtgcaggtgcaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctggcacatcatcatagcctcctgcttctactacgtcgccaccacttacttccctctcctccctcaccctctctccgacttgcctctctactgggcctgccaagggtgcgtcctaaccggcgtctgggtcatagcccacgagtgcggccaccacgccttcagcgactac

SEQ ID NO: 10954 - DNA, 355 bp, Artificial
  Mutation in BnaC.FAD2.a introduced by TALE nuclease pair BnFAD2_T01
caggatccatgggtgcaggtggaagaatgcaagtgtctcctccctcaagaagtctgaaaccgacaccatcaagcgcgtaccctgcgagacaccgcccttcactgccggacaactcaagaaatcaatcccaccgcactgtttcaaacgctccatccctagctctttctcctacctcatctggaccatcatcatagcctcctgcttctactacgtcgccaccacttacttccctctcctccctcaccctctatcccccttcgccgcctggcctctctactgggcctgccaagggtgcgtcctaaccggcgtctgggtcatcgcccacgagtgcggccaccacgccttcagcgactac

SEQ ID NO: 10955 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttactaccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 10956 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 10957 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccggcctctctactgggcctgccaagggtgcgtcctaaccggcgtctgggtcatagcccacgagtgcggccaccacgccttcagcgactac

SEQ ID NO: 10958 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccacttctctacggggcctgccaggggtccgtccaacccggcgtcggggtcatcgcccacgagggcggcccccacgcctgcacccactcc

SEQ ID NO: 10959 - DNA, 323 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctaagggtgcgtcctaaccggcgtctgggtcatagcccacgagtgcggccaccacgccttcagcgactac

SEQ ID NO: 10960 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccaacgtggcctctctactgggcctgccaagggtgcgtcctaaccggcgtctgtgtcatagcccacgagtgtggccaccacgccttcagcgactac

SEQ ID NO: 10961 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtcggggtcatagcccacgagtgcggccaccacgccttcagcgactac

SEQ ID NO: 10962 - DNA, 344 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcatgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 10963 - DNA, 348 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactcc

SEQ ID NO: 10964 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaacgggcctctgggtcatagcccacgagtgcggccaccacgccttcagcgactac

SEQ ID NO: 10965 - DNA, 404 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcggatttgtcatactcaggagagcgttcaccgacaaacaacagataaaacgaaaggcccgcctggcctctctactgggcctgccaagggggcgtcctaaccggcgtctgggtcatagcccacgagtgcgaccaccacgccttcagcgactac

SEQ ID NO: 10966 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgacccctcgctctttctcctacctcatctgggacatcatcatagcctcctgcttctactacgtcgccaccacttacttccctcgcctccctcaccctctctcctacatttggcctctctactgggcctgccaagggtgcgtcctaacgggcctctgggtcatagcccacgagtgcggccaccacgccatcagcgactac

SEQ ID NO: 10967 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagctactac

SEQ ID NO: 10968 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgcttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 10969 - DNA, 347 bp, Artificial
  Mutation in BnaC.FAD2.a introduced by TALE nuclease pair BnFAD2_T01
caggatccatgggtgcaggtagaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctaatacgtcgccaccacttacttccctctcctccctcaccctctctcctccttgcctctctactgggcctgccaagggtgcgtcctaacgggcctctgggtcatcgcccacgaatgcggccaccgcgccttcagcgactac

SEQ ID NO: 10970 - DNA, 318 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctccttctcctacctcctcttcgacatcatcatagcctcctgcttctactacgtcgccaccacttggcaggcctctctactgggcctgccaagggtgcgtcctaaccggcgtctgggtcatagcccacgagtgcggccaccacgccttcagcgactac

SEQ ID NO: 10971 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgtgcctgccaagggtgcgtcctaaccggcgtctgggtcatagcccacgagtgcggccaccacgccttcagcgactac

SEQ ID NO: 10972 - DNA, 326 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggctgcgtcctaaccggcgtctgggtcatagcccacgagtgcggccaccacgccttcagcgacctac

SEQ ID NO: 10973 - DNA, 347 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgtcctctctactgggcctgccaagggtgcgtcctaaccggcgtctgggtcatagcccacgagtgcggccaccacgccttcagcgactac

SEQ ID NO: 10974 - DNA, 345 bp, Artificial
  Mutation in BnaC.FAD2.a introduced by TALE nuclease pair BnFAD2_T01
caggatccatgggtgcaggtggaagaatgcaagtgtatcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctaggcctctctactgggcctgccaagggtgcgtcctaaccggcgtcggggtcattgcccacgagtgcggcctccacgccttcagcgactac

SEQ ID NO: 10975 - DNA, 350 bp, Artificial
  Mutation in BnaC.FAD2.a introduced by TALE nuclease pair BnFAD2_T01
caggatccatgggtgcaggtgcaagaatgcaagtgtcccctcactccaagaagtctgaaaccgacaccatcaagcgcgtaccctgcgagacaccgcccttcactgtcggagaactcaagaaagcaatcccaccgcactgcttcaaacgctccatccctcgctccttctcctacctcctcttcgacatcctcgtctcctcctccctctaccacctctccacagcctacttccctctcctccctcaccctctctcctaccactggcctctctactgggcctgccatggctgcgtcctaaccggcgtctgggtcatagcccacgagtgcggccaccacgccttcagcgactac

SEQ ID NO: 10976 - DNA, 334 bp, Artificial
  Mutation in BnaC.FAD2.a introduced by TALE nuclease pair BnFAD2_T01
caggatccatgggtgcaggtggaagaatgcaagtgtctcctcactccaagaagtctgagaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctgccaagggtgcgtcctaaccggcgtctgggtcatagcccacgagtgcggccaccacgccttcagcgactac

SEQ ID NO: 10977 - DNA, 380 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcacagtggtccggcgcacgcgctctggaggcctgcctctctactgggcctgccaagggtgcgtcctaaccggcgtctgggtcatagcccacgagtgcggccaccacgccttcagcgactac

SEQ ID NO: 10978 - DNA, 344 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgggcctgccaagggtgcgtcctaaccggcgtctgggtcatagcccacgagtgcggccaccacgccttcagcgactac

SEQ ID NO: 10979 - DNA, 300 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcaatgtttcaaacgctcgatccctcgctctttctcctacctcatctgggacatcatcatagcctcctgcttctactacgtctctctactgggcctgccaagggtgcgtcctaaccggcgtctgggtcatagcccacgagtgcggccaccacgccttcagcgactac

SEQ ID NO: 10980 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccttggcctctctactgggcctgccaagggtgcgtcctaaccggcgtctgggtcatagcccacgagtgcggccaccacgccttcagcgactac

SEQ ID NO: 10981 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgtgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgccgcctggcctcgctactgggcctgccaagggtgcgtcctaaccggcgtctgggtcatagcccacgagtgcggccaccacgccttcagcgactac

SEQ ID NO: 10982 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatcccacgctctttctcctacctcatctgggacatcatcatagcctcctgcttctactacttctcccccacctacttccctctcctccctcaccccctctggcccctctactgggcctgccaagggtgcgtcctaaccggcgtctgggtcatcgcccacgagtgcggccaccacgccttcagcgactac

SEQ ID NO: 10983 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttcctctctactgggcctgccaagggtgcgtcctaaccggcgtctgggtcatagcccacgagtgcggccaccacgccttcagcgctac

SEQ ID NO: 10984 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgccgccaccacttacttccctctcctccctcaccctctctcccctggcctctctactgggcctgccaagggtgcgtcctaacgggcgtctgggtcatagcccacgagtgcggccaccacgccttcagcgactac

SEQ ID NO: 10985 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaaggctgcgtcctaacgggcctctgggtcatcgcccacgaatgcggccaccacgccctcagcgactac

SEQ ID NO: 10986 - DNA, 380 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacagtgggccggcgcacgcgctctggaggcctgcctctctactgggcctgccaagggtgcgtcctaaccggcgtctgggtcatagcccacgagtgcggccaccacgccttcagcgactac

SEQ ID NO: 10987 - DNA, 277 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacgccttcagcgactac

SEQ ID NO: 10988 - DNA, 338 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcctgccaagggtgcgtcctaacgggcctctgggtcatagcccacgagtgcggccaccacgccttcagcgactac

SEQ ID NO: 10989 - DNA, 350 bp, Artificial
  Mutation in BnaC.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcataccctcctgcttctactacgtcgccaccacttacttccctctcctccctcaccctctctcctacttttggcctctctactgggcctgccaagggtgcgtcctaaccggcgtctgggtcatagcccacgagtgcggccaccacgccttcagcgactac

SEQ ID NO: 10990 - DNA, 349 bp, Artificial
  Mutation in BnaC.FAD2.a introduced by TALE nuclease pair BnFAD2_T01
caggatccatgggtgcaggtcgaagaatgcaagtgtctcctccctccaagaagtctgaaaccgacaccatcaagcgcgtaccctacgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaacgggcctctgggtcatcgcccacgaatgcggccaccacgccttcagcgactac

SEQ ID NO: 10991 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggtgcctggcctctctactgggcctgccaagggtgcgtcctaaccggcgtcggggtcatagcccacgagtgcggccaccacgccttcagcaactac

SEQ ID NO: 10992 - DNA, 331 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcacgactac

SEQ ID NO: 10993 - DNA, 387 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgccatcgtggctggcgctggccaccccctgcccctggcctctctactgggcctgccaaggctgcgtcctaacgggcctctgggtcatagcccacgagtgcggccaccacgccttcagcgactac

SEQ ID NO: 10994 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgtgtcatagcccacgagtgcggccaccacgccttcagcgactac

SEQ ID NO: 10995 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctctttctcctacctcatctgggacatcatcatagcctcctgcttctactacgtcgccaccacttacttccctctcctccctcaccctctctcctactttcctctctactgggcctgccaagggtgcgtcctaaccggcgtctgggtcatagcccacgagtgcggccaccacgccttcagcgactac

SEQ ID NO: 10996 - DNA, 438 bp, Artificial
  Mutation in BnaC.FAD2.a introduced by TALE nuclease pair BnFAD2_T01
caggatccatgggtgcagggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccagctgggccttgtagttgcccttgaagtggccggacacgaacaggaacttgaactcggtcacgctggaggggtacaccttccccctggcctctctactgggcctgccaagggtgcgtcctaaccggcgtctgggtcatagcccacgagtgcggccaccacgcctcagcgactac

SEQ ID NO: 10997 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaacctgcgtctgggtcatagcccacgagtgcggccaccacgccttcagcgactac

SEQ ID NO: 10998 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactaagactgggcctgccaagggtgcgtcctaaccggcgtctgggtcatagcccacgagtgcggccaccacgccttcagcgactac

SEQ ID NO: 10999 - DNA, 351 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaaggctgcgtcctaacgggcctctgggtcatcgcccacgaatgcggccaccacgccttcagcgactac

SEQ ID NO: 11000 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgtctctctactgggcctgccaagggtgcgtcctaacgggcctctgggtcatcgcccacgaatgcggccaccacgccttcagcgactac

SEQ ID NO: 11001 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctcctccccccgggcctctctacggggccggccaagggtgcgtcctacccggcgtcggggtcataccccacgagtgcgcccaccacgccttcaccgactac

SEQ ID NO: 11002 - DNA, 352 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccaagggtgcgtcctaaccggcgtctgggtcatagcccacgagtgcggccaccacgccttcagcgactac

SEQ ID NO: 11003 - DNA, 354 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggtggcctctctactgggcctgccaagggtgcgtcctaaccggcgtctgggtcatagcccacgagtgcggccaccacgccttcagcgactac

SEQ ID NO: 11004 - DNA, 340 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactctactgggcctgccaaggctgcgtcctaacgggcctctgggtcatagcccacgagtgcggccaccacgccttcagcgactac

SEQ ID NO: 11005 - DNA, 387 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgccatcgtggctggcgatggccaccacctgctcctggcctctctactgggcctgccaagggtgcgtcctaaccggcgtctgggtcatagcccacgagtgcggccaccacgccttcagcgactac

SEQ ID NO: 11006 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaaggctgcgtcctaacgggcctctgggtcatcgcccacgaatgcggccaccacgccttcagcgacta

SEQ ID NO: 11007 - DNA, 300 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccaaggctgcgtcctaacgggcctctgggtcatcgcccacgaatgcggccaccacgccttcagcgactac

SEQ ID NO: 11008 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctacctcaccctctctactacttggcctctctactgggcctgccaagggtgcgtcctaaccggcgtctgggtcatagcccacgagtgtggccaccacgccttcagcgactac

SEQ ID NO: 11009 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagtcgtctgaaaccgacaccatcaagcgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccacctggcctctctactgggcctgccaagggtgcgtcctaaccggcgtctgggtcatagcccacgagtgcggccaccacgccttcagcgactac

SEQ ID NO: 11010 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctactctcctctctactgggcctgccaagggtgcgtcctaaccggcgtctgggtcatagcccacgagtgcggccaccacgccttcagcaactac

SEQ ID NO: 11011 - DNA, 335 bp, Artificial
  Mutation in BnaC.FAD2.a introduced by TALE nuclease pair BnFAD2_T01
caggatccatggatgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttagcctgccaagggtgcgtcctaaccggcgtctgggtcatagcccacgagtgcggccaccacgccttcagcgactac

SEQ ID NO: 11012 - DNA, 332 bp, Artificial
  Mutation in BnaC.FAD2.a introduced by TALE nuclease pair BnFAD2_T01
caggatccatgggtgcaggtgcaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccgccacgccttcagcgactac

SEQ ID NO: 11013 - DNA, 340 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctactggcctctctactgggcctgccaagggtgtgtcctaaccggcgtctgggtcatagcccacgagtgcggccaccacgccttcagcgactac

SEQ ID NO: 11014 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgcttcaaacgctcgatccctcgctctttctcctacctcatctgggacatcatcatagcctcctgcttctactacgtcgccaccacttacttctctctcctccctcaccctctctcctacttcgtggcctctctactgggcctgccaagggtgcgtcctaaccggcgtctgggtcatagcccacgagtgcggccaccacgccttcagcgactac

SEQ ID NO: 11015 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 11016 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctaccacctctccacagcctacttccctctcctcccccaccctctcccttacctggcccctctactgggcctgccaaggctgcgtcctaacgggcctctgggtcatcgcccacgaatgcggccaccacgccttcagcgactat

SEQ ID NO: 11017 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacctctctactgggcctgccaagggtgcgtcctaaccggcgtctgggtcattgcccacgagtgctgcctccgcgccttcaacgactac

SEQ ID NO: 11018 - DNA, 339 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgggtcatagcccacgagtgcggccaccacgccttcagcgactac

SEQ ID NO: 11019 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaacgggcctctgggtcatagcccacgagtgcggccaccacgccttcagcgactac

SEQ ID NO: 11020 - DNA, 347 bp, Artificial
  Mutation in BnaC.FAD2.a introduced by TALE nuclease pair BnFAD2_T01
caggatccatgggtgcaggaggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtcggggtcttagcccacgagtgctgcgaccacgccttcagcgactac

SEQ ID NO: 11021 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgccctttctcctacctcatctgggacatcatcatagcctcctgcttctactacgtcgccaccacttacttccctctcctccctcaccctctctcctacttggcctctctactgggcctgccaagggtgcgtcctaacaggcgtctgggtcatagcccacgagtgcggccaccacgccttcagcgactac

SEQ ID NO: 11022 - DNA, 299 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctccgcttctactacgtctctctactgggcctgccaagggtgcgtcctaaccggcgtctgggtcatagcccacgagtgcggccaccacgccttcagcgactac

SEQ ID NO: 11023 - DNA, 441 bp, Artificial
  Mutation in BnaC.FAD2.a introduced by TALE nuclease pair BnFAD2_T01
caggatccatgggtgcaggtggaagaatgcaagtgtctcctccatccaagaagtctgaacccgacaacatcaagcgcgtaccctgcgagacaccgcccttcactgtcggagaactcaagaaagcaatcccaccgcaatgtttcaaacgctcgatccctcgctctttctcctacctcatctgggacatcatcatagcctcctgcttctactacgtcgccaccacttacttccctctcctccctcaccctctcgcctactggtggccctcgccatccacgagggtggcaagcaggcgctggagacggtcccgcggctgttgccggttctgtgccaggcccacggcttcacccctcgcctctctactgggcctgccaagggtgcgtcctagccggcgtctgggtcatagcccacgattgcggccaccacgccttcagcgactac

SEQ ID NO: 11024 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccatcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 11025 - DNA, 331 bp, Artificial
  Mutation in BnaC.FAD2.a introduced by TALE nuclease pair BnFAD2_T01
caggatcctgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcagagcccacgagtgcggccaccacgccttcagcgactac

SEQ ID NO: 11026 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttcccctacctcatctgggacatcatcatagcctcctgcttctactacgtcgccaccacttacttccctctcctccctcaccctctctctctctactgggcctgccaagggtgcgtcctaaccggcgtctgggtcatagcccacgagtgcggccaccacgccttcagcgactac

SEQ ID NO: 11027 - DNA, 348 bp, Artificial
  Mutation in BnaC.FAD2.a introduced by TALE nuclease pair BnFAD2_T01
caggagccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcggcctctctactgggcctgccaagggtgcgtcctaaccggcgtctgggtcatagcccacgagtgcggccaccacgccttcagcgactac

SEQ ID NO: 11028 - DNA, 352 bp, Artificial
  Mutation in BnaC.FAD2.a introduced by TALE nuclease pair BnFAD2_T01
caggatccatgggtgcaggtggaagaatgcaagtctctcctccctccaaatactctgaaaccgacaccatcaaacgcgtaccctgcgagacaccgcccttcactctcggagacctcaagaaagcaatcccaccgcactgcttcaaacgctccatccctcgctctttctcctccctcatctcgtccttcctcctaccctcctgcttccaacacgcccccaccactcacttccctctcctccctccccccctcccctcctccgctggcctctctactgggcctgccaagggtgcgtcctaaccggcgtctgggtcatagcccacgaatgcggccaccacgccttcagcgactac

SEQ ID NO: 11029 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccgcctggcctctctactgggcctgccaagggtgcgtcctaaccggcgtctgggtcatagcccacgagtgcggccaccacgccttcagcgactac

SEQ ID NO: 11030 - DNA, 342 bp, Artificial
  Mutation in BnaC.FAD2.a introduced by TALE nuclease pair BnFAD2_T01
caggatccatgggtgcaggtggaagaatgcaagtgtctcctccctccacgaagtctgaaaccgacaccatcaagcgcgtaccctgcgagacaccgcccttcactgtcggagaactcaagaaagcaatcccaccgcactgtttcaaacgctccatccctcgctctttctcctacctcatctgggacatcatcatagcctcctgcttctactacgtcgccacctcttacttccctctcctccctcaccctctcccctcctctctactgggcctgccaagggtgcgtcctaaccggcgtctgggtcatagcccacgagtgcggccaccacgccttcagcgactac

SEQ ID NO: 11031 - DNA, 380 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacagtggtctggcgcacgcgctctggaggcctgcctctctactgggcctgccaagggtgcgtcctaaccggcgtctgggtcatagcccacgagtgcggccaccacgccttcagcgactac

SEQ ID NO: 11032 - DNA, 343 bp, Artificial
  Mutation in BnaC.FAD2.a introduced by TALE nuclease pair BnFAD2_T01
caggatccatgggtgcagggggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacctctctactgggcctgccaaggctgcgtcctaacgggcctctgggtcatcgcccacgaatgcggccaccacgccttcagcgactac

SEQ ID NO: 11033 - DNA, 345 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctactccctcaccctctctcctactcctctctactgggcctgccaaggctgcgtcctaacgggcctctgggtcatagcccacgagtgcggccaccacgccttcagcgactac

SEQ ID NO: 11034 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgtgcctgccaagggtgcgtcctaaccggcgtctgggtcatagcccacgagtgcggccaccacgccttcagcgactac

SEQ ID NO: 11035 - DNA, 358 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctaacctggcctctctactgggcctgccaagggtgcgtcctaaccggcgtctggttcatagcccacgagtgcggccaccacgccttcagcgactac

SEQ ID NO: 11036 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatctctactgggcctgccaagggtgcgtcctaaccggcgtctgggtcatagcccacgagtgcggccaccacgccttcagcgactac

SEQ ID NO: 11037 - DNA, 377 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaacgctcgatccctcgctctttctcctacctcatctgggacatcatcatagcctcctgcttctactacgtcgccaccacttacttccctctcctccctcaccctctctcctacttcgcctccagcgcctgcttgccgccatcgtggctggcgatggccaccacctgctccggggtcaagccgtgagggctgggtcatagcccacgagtgcggccaccacgccttcagcgactac

SEQ ID NO: 11038 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctggggcatagcccacgagtgcggccaccacgccttcagcgactac

SEQ ID NO: 11039 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccgtaactgtcggagaactcaagaaagcaatcccaccccactgtttcaaacgctcgatccctccctctttctcctacctcatctgggacatcatcatagcctcctgcttctactacgtcgccaccacttacttccctctcctccctcaccctctcgcctagcctctctactgggcctgccaagggtgcgtcctaaccggcgtctgggtcagagcccacgagtgctgcggccgcgccatcagcgactac

SEQ ID NO: 11040 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccaacttggcctctctactgggcctgccaagggtgcgtcctaaccggcgtcggggtcatagcccacgagtgcggccaccacgccttcagcgactac

SEQ ID NO: 11041 - DNA, 356 bp, Artificial
  Mutation in BnaC.FAD2.a introduced by TALE nuclease pair BnFAD2_T01
caggatccatgggtgcaggtgcaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 11042 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcccctctactgggcctgccaagggtgcgtcctaaccggcgtctgggtcatagcccacgagtgcggccaccacgccttcagcgactac

SEQ ID NO: 11043 - DNA, 339 bp, Artificial
  Mutation in BnaC.FAD2.a introduced by TALE nuclease pair BnFAD2_T01
caggagccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcccccctcacccgctggcctctctactgggcctgccaagggtgcgtcctaaccggcgtctgggtcatagcccacgagtgcggccaccacgccctcagcgactac

SEQ ID NO: 11044 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcgccgcctggcctctctactgggcctgccaagggtgcgtcctaaccggcgtctgggtcatagcccacgagtgcggccaccacgccttcagcgactac

SEQ ID NO: 11045 - DNA, 390 bp, Artificial
  Mutation in BnaC.FAD2.a introduced by TALE nuclease pair BnFAD2_T01
caggatccatgggtgcaggtgcaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcgatggccaccacctgctggggggtcaagccgtgggcggcctctctactgggcctgccaagggtgcgtcctaaccggcgtctgggtcatagcccacgagtgcggccaccacgccttcagcgactac

SEQ ID NO: 11046 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacacaatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccaagggtgcgtcctaacgggcctctgggtcatagcccacgagtgcggccaccacgccttcagcgactac

SEQ ID NO: 11047 - DNA, 348 bp, Artificial
  Mutation in BnaC.FAD2.a introduced by TALE nuclease pair BnFAD2_T01
caggatccatgggtgcaggtggaagaatgcaagtgtatcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 11048 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgagtgcggccaccacgccttcagcgactac

SEQ ID NO: 11049 - DNA, 349 bp, Artificial
  Mutation in BnaC.FAD2.a introduced by TALE nuclease pair BnFAD2_T01
caggatccatgggtgcaggtggaagaatgcaagtctctcctccctccaagaagcctgaaaccgacaccatcaagcgcgtaccctgcaagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgctttggcctctctactgggcctgccaagggtgcgtcctaaccggcgtctgggtcatagcccacgagtgcggccaccacgccttcagcgactac

SEQ ID NO: 11050 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcaccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 11051 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgactggcctctctactgggcctgccaagggtgcgtcctaaccggcgtctgggtcatcgcccacgaatgcggccaccacgccttcagcgactac

SEQ ID NO: 11052 - DNA, 342 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctaactctctactgggcctgccaagggtgcgtcctaaccggcgtctgggtcatagcccacgagtgcggccaccacgccttcagcgactc

SEQ ID NO: 11053 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttacctctctactgggcctgccaagggtgcgtcctaaccggcgtctgggtcatagcccacgagtgcggccaccacgccttcagcgactac

SEQ ID NO: 11054 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccgcgccttcagcgactac

SEQ ID NO: 11055 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgacccctcgctctttctcctacctcatctgggacatcatcatagcctcctgcttctactacgtcgccaccacttacttccctctcctccctcaccctctctcctacttggcctctctactgggcctgccaagggtgcgtcctaacgggcctctgggtcatagcccacgagtgcggccaccacgccttcagcgactac

SEQ ID NO: 11056 - DNA, 398 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgccttggcaacgctgcgatcatgtcctgatacttgacagcgacggtccctggcctctctactgggcctgccaaggctgcgtcctaaccggcgtctgggtcatagcccacgagtgcggccaccacgccttcagcgactac

SEQ ID NO: 11057 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgtgtcatagcccacgagtgcggccaccacgcctcagcgactac

SEQ ID NO: 11058 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatcccacgctccttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 11059 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctaccccaccctctcccttaccttggcccctctactgggcctgccaaggctgcgtcctaacgggcctctgggtcatcgcccacgaatgcggccaccacgccttcagcgactac

SEQ ID NO: 11060 - DNA, 347 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattggcctctctactgggcctgccaagggtgcgtcctaaccggcgtctgggtcatagcccacgagtgcggccaccacgccttcatcgactac

SEQ ID NO: 11061 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcagcctctctactgggcctgccaagggtgcgtccgaaccggcgtcggggtcatagcccacgagtgcggcgaccgcgccatcagcaactac

SEQ ID NO: 11062 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcattcccaccgcactgtttcaaacgctcgatccctcgctctttctcctacctcatctgggacatcatcatagcctcctgcttctactacgtcgccaccacttacttccctctcctccctcaccctctcgcctaggcctctctactgggcctgccaagggtgcgtcctaacgggcctctgggtcatcgcccacgaatgcggccaccacgccttcagcgactac

SEQ ID NO: 11063 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctcccccaccctctcccttccctcccctctactgggcctgccaaggctgcgtcctaacgggcgtctgggtcatagcccacgagtgcggccaccacgccttcagcgactac

SEQ ID NO: 11064 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttaaaacgctcgatccctcgctctttctcctacctcatctgggacatcatcatagcctcctgcttctactacgtcgccaccacttacttccctctcctccctcaccctctctcctcccctggcctctctactgggcctgccaagggtgcgtcctaacgggcctctgggtcatagcccacgagtgcggccaccacgccttcagcgactac

SEQ ID NO: 11065 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcgaacgctcgatccctcgctctttctcctacctcatctgggacatcatcatagcctcctgcttctactacgtcgccaccacttacttccctctcctccctcagcctctctactgggcctgccaagggtgcgtcctaaccggcgtctgggtcatagcccacgagtgcggccaccacgccttcagcgactac

SEQ ID NO: 11066 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaatcggcgtctgggtcatagcccacgaatgcggccaccacgccttcagcgactac

SEQ ID NO: 11067 - DNA, 350 bp, Artificial
  Mutation in BnaC.FAD2.a introduced by TALE nuclease pair BnFAD2_T01
caggatccatgggtgcaggtggaagaatgcaagtgtttcctccctccaagaagtgtgaaaccgacacaatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtctggcctctctactgggcctgccaaggctgcgtcctaacgggcctctggttcagcgcccacgaatgcggccaccacgccttcagcgactac

SEQ ID NO: 11068 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcctaccgcactgtttcaaacgctcgatccctcgctctttctcctacctcatctgggacatcatcatagcctcctgcttctactacgtcgccaccacttacttccctctcctccctcaccctctctcctactacctggcctctctactgggcctgccaagggtgcgtcctaaccggcgtctgggtcatagcccacgagtgcggccaccacgctttcagcgactac

SEQ ID NO: 11069 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgagtgcggccaccacgccttcagcgactac

SEQ ID NO: 11070 - DNA, 312 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaacgggcctctgggtcattgcccacgaatgcggccaccacgccttcagcgactac

SEQ ID NO: 11071 - DNA, 349 bp, Artificial
  Mutation in BnaC.FAD2.a introduced by TALE nuclease pair BnFAD2_T01
caggatccatgggtgcagggggaagaatgcaagtgtctcctccctccagctcccccggaaccaacaccctcaaccgcgtcccctgcgagacaccaccattcactctcggagacctcaagaaagcaatcccaccgcactgtttcaaacgctcgctccctcgctctttctcctacctcatctgggacatcatcatagcctcctgcttctactacgtcgccaccacttacttccctctcctccctcgcccgctctcctactttggcctctctactgggcctgccaagggtgcgtcctaaccggcgtctgggtcatagcccacgagtgctgccaccacgccatcagcgactac

SEQ ID NO: 11072 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaatcgacaccatcaagcgcgtaccctgcgagacaccgcccttcactgtcggagaactcaagaaagcaatcccaccgcactgtttcaaacgctcgatccctcgccctttctcctacctcatctgggacatcatcatagcctcctgcttctactacgtcgccaccacttacttccctctcctccctcaccctctctcctccttcgacgcctggcctctctactgggcctgccaagggtgcgtcctaaccggcgtctgggtcatagcccacgagtgcggccaccacgcctcagcgactac

SEQ ID NO: 11073 - DNA, 341 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatctctactgggcctgccaagggtgcgtcctaaccggcgtctgggtcatagcccacgagtgcggccaccacgccttcagcgactac

SEQ ID NO: 11074 - DNA, 277 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacgccttcagcgactac

SEQ ID NO: 11075 - DNA, 345 bp, Artificial
  Mutation in BnaC.FAD2.a introduced by TALE nuclease pair BnFAD2_T01
caggatccatgggtgcaggtggaagaatgcaagtgactcctcccaccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcgcacctaagcctctctactgggcctgccgagggtgcgtccgaaccggcaactggggcatggcccacgagtgcggccttcggtccttcagcgactgc

SEQ ID NO: 11076 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtcctaaccggcgtctgggtcatagcccacgagtgcggcctccacgccttcagcgactac

SEQ ID NO: 11077 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccccactgtttcaaacgctcgatccctcgctctttctcctacctcatctgggacatcatcatagcctcctgcttctactacgttgccaccacttacttccctctcctcccccaccctcacccttccccctggcccctctactgggcctgccaagggtgcgtcctcacgggcctctggttcatagcccacgagtgctgcctccacgccttcatcgactac

SEQ ID NO: 11078 - DNA, 424 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttctccagcgcctgcttgccgccatcgtggctggcgatggccaccacctgctggggggtcaagccgtgggcctggcatggcctctctactgggcctgccaagggtgcgtcctaaccggcgtctgggtcatagcccacgagtgcggccaccacgccttcagcgactac

SEQ ID NO: 11079 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaatgcaatcccaccgcactgtttcaaacgctcgatccctcgctctttctcctacctcatctgggacatcatcatagcctcctgcttctactacgtcgccaccacttacttccctctcctccctcaccctctctcctacggctggcctctctactgggcctgccaagggtgcgtcctaaccggcgtctgggtcatagcccacgagtgcggccaccacgccttcagcgactac

SEQ ID NO: 11080 - DNA, 354 bp, Artificial
  Mutation in BnaC.FAD2.a introduced by TALE nuclease pair BnFAD2_T01
caggatccatgggtgcaggcggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccaagggtgcgtcctaaccggcgtctgggtcatagcccacgagtgcggccaccacgccttcaacgactac

SEQ ID NO: 11081 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgtgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctggcctctctactgggcctgccaagggtgcgtcctaaccggcgtctgggtcatagcccacgagtgcggccaccacgccatcagcgactac

SEQ ID NO: 11082 - DNA, 337 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcatgaaagcaatcccacctcactgcttcaaacgctccatcccacgctccttctcctacctcatctgggacatcatcatagcctcctgcttctactacgtcgccaccacttacttccctctcctccctcaccctctctcctctactgggcctgccaagggtgcgtcctaaccggcgtctgggtcatagcccacgagtgcggccaccacgccttcagcgactac

SEQ ID NO: 11083 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactactgggcctgccaaggctgcgtcctaaccggcgtctgggtcatagcccacgagtgcggccaccacgccttcagcgactac

SEQ ID NO: 11084 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcggctctctactgggcctgccaaggctgcgtcctaacgggcgtctgggtcatagcccacgagtgcggccaccacgccttcagcgactac

SEQ ID NO: 11085 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccccggcctctctactgggcctgccaagggtgcgtcctaaccggcgtctgggtcatagcccacgattgcggccaccacgccttcagtgactac

SEQ ID NO: 11086 - DNA, 277 bp, Artificial
  Mutation in BnaC.FAD2.a introduced by TALE nuclease pair BnFAD2_T01
caggatccatgggtgcaggtggaagaatgcaagtgcctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacgccttcagcgactac

SEQ ID NO: 11087 - DNA, 340 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccaagggtgcgtcctaaccggcgtatgggtcatagcccacgagtgcggccaccacgccttcagcgactac

SEQ ID NO: 11088 - DNA, 347 bp, Artificial
  Mutation in BnaC.FAD2.a introduced by TALE nuclease pair BnFAD2_T01
caggatccatgggtgcaggtggaagaatgcaagtgtctccttcctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccatcagcgactac

SEQ ID NO: 11089 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 11090 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacccttcagcgactac

SEQ ID NO: 11091 - DNA, 404 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttcgcttgccgccatcgtggctggcgatggccaccaccggctccggggtcaagccgtgggcctctctactgggcctgccaagggtgcgtcctaaccggcgtctgggtcatagcccacgagtgcggccaccacgccttcagcgactac

SEQ ID NO: 11092 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctactgcctctctactgggcctgccaagggtgcgtcctaaccggcgtctgggtcagagcccacgagtgcggccaccacgccttcagcgactac

SEQ ID NO: 11093 - DNA, 355 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 11094 - DNA, 347 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 11095 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccagaaccaacaccctcaaacgcgtcccctgcgagacaccgcccttcactgtcggtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaaggctgcgtcctaacgggcctctgggtcatcgcccacgaatgcggccaccacgccttcagcgactac

SEQ ID NO: 11096 - DNA, 331 bp, Artificial
  Mutation in BnaC.FAD2.a introduced by TALE nuclease pair BnFAD2_T01
caggatccatgggtgcaggtagaagaatgcaagtgtctcctccctccaagaagtctgaaaccgacaccatcaagcgcgtaccctgcgagccaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgacac

SEQ ID NO: 11097 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcagcctctctactgggcctgccaagggtgcgtcctaacgggcgtctgggtcatagcccacgagtgcggccaccacgccttcagcgactac

SEQ ID NO: 11098 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgcttcaaacgctcgatccctcgctctttctcctacctcatctgggacatcctcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 11099 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaagcgcgtaccctgcgagacaccgcccttcactgtcggagaactcaagaaagcaatcccacctcactgcttcaaacgctcgatccctcgctctttctcctacctcatctgggacatcatcatagcctcctgcttctactacgtcgccaccacttacttccctctcctccctcaccctctctccttcggctctctactgggcctgccaagggtgcgtcctaacgggcctctgggtcatagcccacgagtgcggccaccacgccttcagcgactac

SEQ ID NO: 11100 - DNA, 404 bp, Artificial
  Mutation in BnaC.FAD2.a introduced by TALE nuclease pair BnFAD2_T01
caggatccatgggtgcaggtggaataatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcggatttgtcctactcaggagagcgttcaccgacaaacaacagataaaacgaaaggcccgcctgacccctctactgggcctgccaaggctgcgtcctaacgggcctctgggtcatcgcccacgaatgcggccaccacgccttcagcgactac

SEQ ID NO: 11101 - DNA, 355 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctacttcgcctttggcctctctactgggcctgccaagggtgcgtcctaaccggcgtctggggcatagcccacgagtgcggccaccacgccttcagcgactac

SEQ ID NO: 11102 - DNA, 349 bp, Artificial
  Mutation in BnaC.FAD2.a introduced by TALE nuclease pair BnFAD2_T01
caggatcccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctccctcctacttggcctctctactgggcctgccaagggtgcgtcctaaccggcgtctgggtcatcgcccacgaatgcggccaccacgccttcatcgactac

SEQ ID NO: 11103 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccatgcgagacaccacccttcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 11104 - DNA, 339 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaaggctgcgtcctaacgggcctctgggtcatcgcccacgaatgcggccaccacgccttcagcgactac

SEQ ID NO: 11105 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcatcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctggaactgccaagggtgcgtcctaaccggcgtctgggtcatagcccacgagtgcggccaccacgccttcagcgactac

SEQ ID NO: 11106 - DNA, 378 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatatgggacatcatcatagcctcctgcttctactacgtcgccaccacttacttccctatactccctcaccctctctcctctttgatccgtttcctgaagaggatctatgtgattgcctctctactgggcctgccaaggctgcgccctaacgggcgtctgggtcatagcccacgagcgcggccaccacgccttcagcgactac

SEQ ID NO: 11107 - DNA, 401 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcgccataaacttccaggcatcaaactaagcagaaggccatccgtccataggctggcctctctactgggcctgccaagggtgcgtcctaaccggcgtctgggtcatagcccacgagtgcggccaccacgccttcagcgactac

SEQ ID NO: 11108 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcccacttgcctctctactgggcctgctaagggtgcgtcctaaccggcgtctgggtcatagcccacgagtgcggccaccacgccttcagcgactac

SEQ ID NO: 11109 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcagagcctcctgcttctactacgtcgccaccacttacttccctctcctccctcaccctctctcctacttctggcctctctactgggcctgccaaggctgcgtcctaacgggcctctgggtcatagcccacgagtgcggccaccacgccttcagcgactac

SEQ ID NO: 11110 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctcctgggcctgccaaggctgcgtcctaacgggcctctgggtcatcgcccacgaatgcggccaccacgccttcagcgactac

SEQ ID NO: 11111 - DNA, 345 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 11112 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcactcaccctctccctctctactgggcctgccaagggtgcgtcctaaccggcgtctgggtcatagcccacgagtgctgcctccacgccttcagcgactac

SEQ ID NO: 11113 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcctctctactgggcctgccaagggtgcgtcctaaccggcgtctgggtcatagcccacgagtgcggccaccacgccttcagcgactac

SEQ ID NO: 11114 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaacctgcgtctgggtcatagcccacgagggcggccaccacgccttcagcgactac

SEQ ID NO: 11115 - DNA, 348 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaacgggcctctgggtcatcgcccacgaatgcggccaccacgccttcagcgactac

SEQ ID NO: 11116 - DNA, 338 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctccctctctactgggcctgccaagggtgcgtcctaaccggcgtctgggtcatagcccgcgagtgcggccaccacgccttcagcgactac

SEQ ID NO: 11117 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccccccctctcccttaccttggcccctctactgggcctgccaaggctgcgtcctaacgggcctctgggtcatcgcccacgaatgcggccagcaggccttcagcgactac

SEQ ID NO: 11118 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccatgagtgcggccaccacgccttcagcgactac

SEQ ID NO: 11119 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacctccctctcctccctcaccctctctcctacttcggcctctctactgggcctgccaagggtgcgtcctaaccggcgtctgggtcatagcccacgagtgcggccaccacgccttcagcgactac

SEQ ID NO: 11120 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacaggcctctctactgggcctgccaagggtgcgtcctaaccggcgtctgggtcatagcccacgagtgcggccaccacgccttcagcgactac

SEQ ID NO: 11121 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 11122 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacacctcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 11123 - DNA, 349 bp, Artificial
  Mutation in BnaC.FAD2.a introduced by TALE nuclease pair BnFAD2_T01
caggatccatgggtgcaggtggaagaatgcaagcctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggccagccaagggggcgtcctaaccggcggctgggtcatagcccacgagtgcggccagcacgccttcagcgactac

SEQ ID NO: 11124 - DNA, 337 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctactgggcctgccaagggtgcgtcctaaccggcgtctgggtcatagcccacgagtgcggccaccacgccttcagcgactac

SEQ ID NO: 11125 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacccctctactgggcctgccaaggctgcgtcctaacgggcctctgggtcatcgcccacgaatgcggccaccacgccttcagcgactac

SEQ ID NO: 11126 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatcgcccacgaatgctgccaccacgccttcagcgactac

SEQ ID NO: 11127 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagatagcaatcccaccgcactgtttcaaacgctcgatccctcgctctttctcctacctcatctgggacatcatcatagcctcctgcttctactacgtcgccaccacttacttccctctcctccctcaccctctctcctaatggcctctctactgggcctgccaagggtgcgtcctaaccggcgtctgggtcatagcccacgagtgcggccaccacgccttcagcgactac

SEQ ID NO: 11128 - DNA, 299 bp, Artificial
  Mutation in BnaC.FAD2.a introduced by TALE nuclease pair BnFAD2_T01
caggatccatgggtgcaggtggaagaatgcaagtctctcctccctccagctccccgaaaccaaaaccctcaaacgcgtcccctgccagacaccgcccttcactgtcggagaactcaagaaagcaatcccaccgcactgtttcaaacgctcgctccctcgctctttctcctacctcatctgggacatcatcatagcctcctgcttctactacgtctctctactgggcctgccaagggtgcgtcctaaccggcgtctgggtcatagcccacgagtgcggccaccacgccatcaacgactac

SEQ ID NO: 11129 - DNA, 372 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctctccagcggcggttgccgccatcgtgcccctctactgggcctgccaaggctgcgtcctaacgggcctctgggtcatcgcccacgaatgcggccaccacgccttcagcgactac

SEQ ID NO: 11130 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccaaggctgcgtcctaaccggcgtctgggtcatagcccacgagtgcggccaccacgccttcagcgactac

SEQ ID NO: 11131 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccatctcccttcccctggcccctctactgggcctgccaaggctgcgtcctaacgggcctctgggtcatcgcccacgaatgcggccaccacgccttcagcgactac

SEQ ID NO: 11132 - DNA, 348 bp, Artificial
  Mutation in BnaC.FAD2.a introduced by TALE nuclease pair BnFAD2_T01
caggatccatgggtgcagggggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 11133 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccacctcactgcttcaaacgctccatcccacgctccttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 11134 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacgtgggcctctctactgggcctgccaagggtgcgtcctaacgggcctctgggtcatcgcccacgaatgcggccaccacgccttcagcgactac

SEQ ID NO: 11135 - DNA, 351 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgagacatcatcatagcctcctgcttctactacgtcgccaccacttacttccctctcctccctcaccctctctcctacttgctggcctctctactgggcctgccaagggtgcgtcctaaccggcgtctgggtcatagcccacgagtgcggcctccacgccttcagcgactac

SEQ ID NO: 11136 - DNA, 436 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaagcgctcgatccctcgctctttctcctacctcatctgggacatcatcatagcctcctgcttctactacgtcgccaccacttacttccctctcctccctcaccctctctcctacttcgccctggctggcgatggccaccacctgctccggggtcaagccgtgggcctggcatctctgccaaatagttgggagccaatgagggcaggcctctctactgggcctgccaagggtgcgtcctaaccggcgtctgggtcatagcccacgagtgcggccaccacgccttcagcgactac

SEQ ID NO: 11137 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtcggggtcatagcccacgagtgcggccaccacgccttcagcgactac

SEQ ID NO: 11138 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgattcctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 11139 - DNA, 347 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccaactggcctctctactgggcctgccaagggtgcggcctaaccggcgtcggggtcatagcccacgagtgcggccaccacgccttcagcgactac

SEQ ID NO: 11140 - DNA, 385 bp, Artificial
  Mutation in BnaC.FAD2.a introduced by TALE nuclease pair BnFAD2_T01
caggatccatgggtgcaggtggaagaatgcaagtgtatcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccgtgggcctggcacggcaccggcaacagccgctggaccgtctccagcgcctgcctggcctctctactgggcctgccaagggtgcgtcctaaccggcgtctgggtcatagcccacgagtgcggcctccacgccttcatcgactac

SEQ ID NO: 11141 - DNA, 342 bp, Artificial
  Mutation in BnaC.FAD2.a introduced by TALE nuclease pair BnFAD2_T01
caggatccatgggtgcagctggaagaatgcaagtctctcctccctccaaaaagcctgaaaccgacaccatcaagcgcgtaccctgcgagacaccgcccttcactgtcggagaactcaagaaagcaatcccaccgcactgtttcaaacgctcgatccctcgctctttcacctacctcatctgggacatcatcatagcctcctgcttctactacgtcgccaccacttacttccctctcctccctcaccctcgcctggcctctctactgggcctgccaagggggcgtcctaaccgacgtctgggtcatagcccacgagtgcggccaccacgccttcagcgactac

SEQ ID NO: 11142 - DNA, 348 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaaggctgcgtcctaacgggcctctgggtcatagcccacgagtgcggccaccacgccttcagcgactac

SEQ ID NO: 11143 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctacctcaccctctctcctacttggcctctctactgggcctgccaagggtgcgtcctaaccggcgtctgggtcatagcccacgagtgcggccaccacgccttcagcgactac

SEQ ID NO: 11144 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttcttctacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 11145 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgggcctctctactgggcctgccaagggtgcgtcctaacgggcctctgggtcatcgcccacgaatgcggccaccacgccttcagcgactac

SEQ ID NO: 11146 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcgcctctctactgggcctgccaagggtgcgtcctaaccggcgtcggggtcatagcccacgagtgcggccaccacgccttcagcgactac

SEQ ID NO: 11147 - DNA, 342 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctctgtctctctactgggcctgccaagggtgcgtcctaaccggcgtctgggtcatagcccacgagtgcggccaccacgccttcagcgactac

SEQ ID NO: 11148 - DNA, 355 bp, Artificial
  Mutation in BnaC.FAD2.a introduced by TALE nuclease pair BnFAD2_T01
caggatccatgggtgcaggtggaagaatgcaagtgtctcatccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaaggctgcgtcctaacgggcctctgggtcatagcccacgagtgcggccaccacgccttcagcgactac

SEQ ID NO: 11149 - DNA, 354 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggtggcctctctactgggccggccaagggtgcgtcctaacgggcctctgggtcatagcccacgagtgcggccaccacgccttcagcgactac

SEQ ID NO: 11150 - DNA, 348 bp, Artificial
  Mutation in BnaC.FAD2.a introduced by TALE nuclease pair BnFAD2_T01
caggatccatgggtgcaggtggaagaatgcaagtctctcctcactccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 11151 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcttctgggtcatagcccacgagggcggccaccacgccttcagcgactac

SEQ ID NO: 11152 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccttcgctctttctcctacctcatctgggacatcatcatagcctcctgcttctactacgtcgccaccacttacttccctctcctccctcaccctctctccttggcctctctactgggcctgccaagggtgcgtcctaaccggcgtctgggtcatagcccacgagtgcggccaccacgccttcagcgactac

SEQ ID NO: 11153 - DNA, 347 bp, Artificial
  Mutation in BnaC.FAD2.a introduced by TALE nuclease pair BnFAD2_T01
caggatccatgggtgcaggtggaagaatgcaagtgtctcctcactccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgcctgcagcgactac

SEQ ID NO: 11154 - DNA, 329 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctctttctcctacctcatctgggacatcatcatagcctcctgcttctactacgtcgccaccacttacttccctctcctccctcaccctctctcctactgccaagggtgcgtcctaaccggcgtctgggtcatagcccacgagtgcggccaccacgccttcagcgactac

SEQ ID NO: 11155 - DNA, 349 bp, Artificial
  Mutation in BnaC.FAD2.a introduced by TALE nuclease pair BnFAD2_T01
caggatccatgggtgcaggcggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatcgcccacgaatgcggcctccacgccttcagcgactac

SEQ ID NO: 11156 - DNA, 357 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccccccgcctggcctctctactgggcctgccaagggtgcgtcctaaccggcgtctgggtcatagcccacgagtgcggccaccacgccttcagcgactac

SEQ ID NO: 11157 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgtggcctctctactgggcctgccaagggtgcgtcctaaccggcgtctgggtcatagcccacgagtgcggccaccacgccttcagcgactac

SEQ ID NO: 11158 - DNA, 350 bp, Artificial
  Mutation in BnaC.FAD2.a introduced by TALE nuclease pair BnFAD2_T01
caggatccatgggtgcaggtggaagaatgcaagtctctcctccctccaacacgtctgaaaccgacaacctcaagcgcgtaccctgcgagacaccgcccttcactgtcggagaactcaagaaagcaatcccaccgcactgtttcaaacgctctatccctcgctctttctcctccctcatctgggacatcatcatagcctccttcttctactacctcgcctccacctacttcactctcctccctccccccctctcctacgcctggcctctctactgggcctgccaagggtgcgtcctaacgggcgtctgggtcatagcccacgagtgcggccaccaagccttcagcgactac

SEQ ID NO: 11159 - DNA, 323 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctaagggtgcgtcctaaccggcgtctgggtcatagcccacgagtgcggccaccacgccttcagcgactac

SEQ ID NO: 11160 - DNA, 350 bp, Artificial
  Mutation in BnaC.FAD2.a introduced by TALE nuclease pair BnFAD2_T01
caggatccatgggtgcagggggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacagctggcctctctactgggcctgccaagggtgcgtcctaaccggcgtctggggcatagcccacgagtgcggccaccacgccatcaacgactac

SEQ ID NO: 11161 - DNA, 346 bp, Artificial
  Mutation in BnaC.FAD2.a introduced by TALE nuclease pair BnFAD2_T01
caggatccaggtgcaggtggaagaatgcacgtgtctcctccctccaagaagtctgaaaccgacaccctcaagcgcgtaccctgcgagacaccgcccttcactgtcggagaactcaagaaagcaatcccacctcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgtggccaccacgccttcagcgactac

SEQ ID NO: 11162 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaacgggcctctgggtcatcgcccacgaatgcggccaccacgccttcagcgactac

SEQ ID NO: 11163 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctactttggcctctctactgggcctgccaagggtgcgtcctaaccggcttctgggtcatagctcacgagtgcggccaccacgccttcagcgactac

SEQ ID NO: 11164 - DNA, 339 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgggtcatagcccacgagtgcggccaccacgccttcagcgactac

SEQ ID NO: 11165 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacctccctctcctccctcaccctctctcctaatggcctctctactgggcctgccaaggctgcgtcctaacgggcctctgggtcatcgcccacgaatgcggccaccacgccttcagcgactac

SEQ ID NO: 11166 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccatcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaagggtgcgtcctaaccggcgtctgggtcatagcccacgagtgcggccaccacgccttcagcgactac

SEQ ID NO: 11167 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattgcctctctactgggcctgccaagggtgcgtcctaacgggcctctgggtcatagcccacgagtgcggccaccacgccttcagcgactac

SEQ ID NO: 11168 - DNA, 414 bp, Artificial
  Mutation in BnaC.FAD2.a introduced by TALE nuclease pair BnFAD2_T01
caggatccatgggtgcaggttgaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttcgccggcaaaatcgcgccgaaggatgtcgctgccgactgggcaatggagcgcctgccggcccacctggcctctctactgggcctgccaagggtgcgtcctaaccggcgtctgggtcatagcccacgagtgcggccaccacgccttcagcgactac

SEQ ID NO: 11169 - DNA, 344 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctagcctctctactgggcctgccaagggtgcgtccgaaccggcgtctgggtcatagcccacgagtgcgtcctccgcgccagcagcgactac

SEQ ID NO: 11170 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggcctgccaagggtgcgtcctaaccggcgtctgggtcatagcccacgagtgcggccaccacgccttcagcgactac

SEQ ID NO: 11171 - DNA, 351 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccacactgtttcaaacgctcgatccctcgctctttctcctacctcatctgggacatcatcatagcctcctgcttctactacgtcgccaccacctacttccctctcctccctcaccctctctcctacttcctggcccctctactgggcctgccaagggtgcgtcctaaccggcgtctgggtcatagcccacgagtgcggccaccacgccttcagcgactac

SEQ ID NO: 11172 - DNA, 332 bp, Artificial
  Mutation in BnaC.FAD2.a introduced by TALE nuclease pair BnFAD2_T01
caggatccatgggtgcaggtggaagaatgcaagtgtctaccccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcggcctaaccggcggctgggtcatagcccacgagtgcggcctccacgccttcagtgactac

SEQ ID NO: 11173 - DNA, 348 bp, Artificial
  Mutation in BnaC.FAD2.a introduced by TALE nuclease pair BnFAD2_T01
caggatccatgggtgcagggggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccacctcttacttccctctcctccctcaccctctctccggcttggcctctctactgggcctgccaagggtgcgtcctaaccggcgtctgggtcatagcccacgagtgcggccaccacgccttcagcgactac

SEQ ID NO: 11174 - DNA, 408 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgagccgaagtttccaaaaggtcgttgatcaaagctcgccgcgttgtttcatcaagccttggcctctctactgggcctgccaagggtgcgtcctaacgggcctctgggtcatagcccacgagtgcggccaccacgccttcagcgactac

SEQ ID NO: 11175 - DNA, 347 bp, Artificial
  Mutation in BnaC.FAD2.a introduced by TALE nuclease pair BnFAD2_T01
caggatccatgggtgcaggtggaagaatgcaagtgtctcccccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactagcctctctactggtcctgccatgggtgcgtcctaaccggcgtctgggtcatagcccgcgagtgcggccaccacgccgtcaacgactac

SEQ ID NO: 11176 - DNA, 300 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccaagggtgcgtcctaatcggcgtctgggtcatagcccacgagtgcggccaccacgccttcagcgactac

SEQ ID NO: 11177 - DNA, 340 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccaagggtgcgtcctaacgggcctctgggtcatagcccacgagtgcggccaccacgccttcagcgactac

SEQ ID NO: 11178 - DNA, 334 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccacgagtgcggccaccacgccttcagcgactac

SEQ ID NO: 11179 - DNA, 342 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 11180 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaaggctgcgtcctaacgggcctctgggtcatcgcccacgaatgcggccaccacgccttcagcgactac

SEQ ID NO: 11181 - DNA, 347 bp, Artificial
  Mutation in BnaC.FAD2.a introduced by TALE nuclease pair BnFAD2_T01
caggatccatgggtgcaggtggaagaatgcaagtgtcccctcctcccagaagtctgaaaccgacaccaacaagcgcgtaccctgcgagacaacgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 11182 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgtgacatcatcatagcctcctgcttctactacgtcgccaccacttacttccctctcctccctcaccctcctctctactgggcctgccaaggctgcgtcctaaccggcgtctgggtcatagcccacgagtgcggccaccacgccttcatcgactac

SEQ ID NO: 11183 - DNA, 346 bp, Artificial
  Mutation in BnaC.FAD2.a introduced by TALE nuclease pair BnFAD2_T01
cagatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaaggctgcgtcctaacgggcctctgggtcatagcccacgagtgcggccaccacgccttcagcgactac

SEQ ID NO: 11184 - DNA, 388 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccacccacgtataacccttcgatgccctgctgaatattgaactgacccggcgactggcctctctactgggcctgccaagggtgcgtcctaaccggcgtctgggtcatagcccacgagtgcggccaccacgccttcagcgactac

SEQ ID NO: 11185 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgggcctctctactgggcctgccaagggtgcgtcctaaccggcgtctgggtcatagcccacgattgcggccaccacgccttcagcgactac

SEQ ID NO: 11186 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaacgggcctctgggtcatcgcccacgaatgcggccaccacgccttcagcgactac

SEQ ID NO: 11187 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacactcgctcctacttcgacgcctggcctctctactgggcctgccaagggtgcgtcctaaccggcgtctgggtcatagcccacgagtgcggccaccacgccttcagcgactac

SEQ ID NO: 11188 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggtgtctgggtcatagcccacgagtgcggccaccacgccttcagcgactac

SEQ ID NO: 11189 - DNA, 339 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgggtcatagcccacgagtgcggccaccacgccttcagcgactac

SEQ ID NO: 11190 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccccctctcctacctcgccgcctggcccctctactgggcctgccaagagtgcgtcctaaccggcgtctgggtcatagcccacgagtgcggccaccacgccttcagcgactac

SEQ ID NO: 11191 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 11192 - DNA, 346 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 11193 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccccctcctccctcaccctctctcctactttggcctctctactgggcctgccaagggtgcgtcctaaccggcgtctgggtcatagcccacgagtgcggccaccacgccttcagcgactac

SEQ ID NO: 11194 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttacctctctactgggcctgccaagggtgcgtcctaaccggcgtctgggtcatagcccacgagtgcggccaccacgccttcagcgactac

SEQ ID NO: 11195 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccgcgccttcagcgactac

SEQ ID NO: 11196 - DNA, 344 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgggcctgccaaggctgcgtcctaacgggcctctgggtcatcgcccacgaatgcggccaccacgccttcagcgactac

SEQ ID NO: 11197 - DNA, 339 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctatggcctctctactgggcctgccaagggtgcgtcctaaccggcgtccgggtcatagcccacgagtgcggccaccacgccttcagcgactac

SEQ ID NO: 11198 - DNA, 352 bp, Artificial
  Mutation in BnaC.FAD2.a introduced by TALE nuclease pair BnFAD2_T01
caggatccatgggtgcaggtggaagaatgcaagtctctactcccaccagctcccccggaaccaacaccctcaaacgagtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgctggcctctctactgggcctgccaagggtgctgccgaacgggcctctgggtcatagcccacgagtgctgcgaccacgccttcagcgactac

SEQ ID NO: 11199 - DNA, 355 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 11200 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatatgggacatcatcatagcctcctgcttctactacgtcgccaccacttacttccctctcctccctcaccctctctcctactctctactgggcctgccaagggtgcgtcctaaccggcgtctgggtcatagcccacgagtgcggccaccacgccttcagcgactac

SEQ ID NO: 11201 - DNA, 342 bp, Artificial
  Mutation in BnaC.FAD2.a introduced by TALE nuclease pair BnFAD2_T01
caggatccatggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 11202 - DNA, 277 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcactcaccctctctcctacttcacgccttcagcgactac

SEQ ID NO: 11203 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaaccccacctcactgcttcaaacgctccatccctcgctccttctcctacctcatctgggacatcatcatagcctcctgcttctactacgtcaccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 11204 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttaaaacgctcgatccctcgctctttctcctacctcatctgggacatcatcatagcctcctgcttctactacgtcgccaccacttacttccctctcctcactcaccctctctcctacttctggcctctctactgggcctgccaagggtgcgtcctaaccggcgtctgggtcatagcccacgagtgcggccaccacgccttcagcgactac

SEQ ID NO: 11205 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcgtcctccacgccttcagcgactac

SEQ ID NO: 11206 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 11207 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctgccctctactgggcctgccaaggctgcgtcctaacgggcctctgggtcatcgcccacgaatgcggccaccacgccttcagcgactac

SEQ ID NO: 11208 - DNA, 349 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctggcctctctactgggcctgccaagggtgcgtcctaaccggcgtctgggtcatagcccacgagtgcggccaccacgccttcagcgactac

SEQ ID NO: 11209 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttggcctctctactgggcctgccaagggtgcgtcctaaccggcgtctgggtcatagcccacgagtgtggccaccacgccttcagcgactac

SEQ ID NO: 11210 - DNA, 357 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcataatagcctcctgcttctactacgtcgccaccacttacttccctctcctccctcaccctctctcctactccgcccgcctggcctctctactgggcctgccaagggtgcgtcctaaccggcgtctgggtcatagcccacgagtgcggccaccacgccttcagcgactac

SEQ ID NO: 11211 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaacgggcctctgggtcatagcccacgagtgcggccaccacgccttcagcgactac

SEQ ID NO: 11212 - DNA, 341 bp, Artificial
  Mutation in BnaC.FAD2.a introduced by TALE nuclease pair BnFAD2_T01
caggatccatgggtgcaggcggaagaatgcaagtgtctcctccctcaaagaagtctgaacccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctggcctctctactgggcctgccaagggtgcgtcctaaccggcttcggggtcatagcccacgagtgcggcctccacgcctgcagcgactac

SEQ ID NO: 11213 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctggaacatcatcatagcctcctgcttctactacgtcgccaccacttacttccctctcctccctcaccctctctcctacttcgccgctctactgggcctgccaagggtgcttcttgaccggcttcgttgttatagcccgcgagtgctgcctccacgccttcagcgactac

SEQ ID NO: 11214 - DNA, 338 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgtgacatcatcatagcctcctgcttctactacgtcgccaccacttacttccctctcctccctcaccctctccctctctactgggcctgccaagggtgcgtcctaaccggcgtctgggtcatagcccacgagtgcggccaccgcgccttcagcgactac

SEQ ID NO: 11215 - DNA, 386 bp, Artificial
  Mutation in BnaC.FAD2.a introduced by TALE nuclease pair BnFAD2_T01
caggatccatgggtgcaggtggaagaatgcaagtgtctcatccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttggccaccaccggctggggggtcaagccgtgggccgggcacagtctctactgggcctgccaaggctgcgtcttaacgggcctcggggtcatagcccacgagtgcggcgaccacgccgtcagcgactac

SEQ ID NO: 11216 - DNA, 334 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccacgagtgcggccaccacgccttcagcgactac

SEQ ID NO: 11217 - DNA, 349 bp, Artificial
  Mutation in BnaC.FAD2.a introduced by TALE nuclease pair BnFAD2_T01
caggatccatgggtgcaggttgaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaacgggcctctgggtcatagcccacgagtgcggccaccacgccttcagcgactac

SEQ ID NO: 11218 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 11219 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaaccggcgtctgggtcatagcccacgagtgcggcctccacgccttcagcgactac

SEQ ID NO: 11220 - DNA, 348 bp, Artificial
  Mutation in BnaC.FAD2.a introduced by TALE nuclease pair BnFAD2_T01
caggatccatgggtgcaggtggaagaatgcaagtgtctcatccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctctctactgggcctgccaagggtgcgtcctaaccggcgtctgggtcatagcccacgagtgcggccaccacgccttcagcgactac

SEQ ID NO: 11221 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctggcctctctactgggcctgccaagggtgcgtcctaaccggcgtctgggtcatagcccacgagtgcggccaccacgccttaagcgactac

SEQ ID NO: 11222 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctacttggcctgccaaggctgcgtcctaacgggcctctgggtcatcgcccacgaatgcggccaccacgccttcagcgactac

SEQ ID NO: 11223 - DNA, 340 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctccctctactgggcctgccaaggctgcgtcctaacgggcctctgggtcatcgcccacgaatgcggccaccacgccttcagcgactac

SEQ ID NO: 11224 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctgcctctctactgggcctgccaagggtgcgtcctaaccggcgtctgggtcatagcccacgagtgcggccaccacgccttcagcgactac

SEQ ID NO: 11225 - DNA, 344 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgcttcaaacgctccatccctcgctccttctcctacctcctcttcgacatcctcgtctcctcctccctctaccacctctccacagcctacttccctctcctccctcaccctctctcctggcctctctactgggcctgccaagggtgcgtcctaaccggcgtctgggtcatagcccacgagtgcggccaccacgccttcagcgactac

SEQ ID NO: 11226 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgcccccacttacttccctctcctccctcaccctctctcctccttcgcctctctactgggcctgccaagggtgcgtcctaaccggcgtctgggtcatagcccacgagtgcggccaccacgccttcagcgactac

SEQ ID NO: 11227 - DNA, 300 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtctctctactgggcctgccaagggtgcgtcctaaccggcgtctgggtcatagcccacgagtgcggccaccacgccttcagcgactac

SEQ ID NO: 11228 - DNA, 347 bp, Artificial
  Mutation in BnaC.FAD2.a introduced by TALE nuclease pair BnFAD2_T01
caggatccatgggtgcaggtggaagaatgcaagtgtatactcccttaaagaagtctgaaaccgacaccataaagcgcgtaccctgcgagacaccgaccttcactgtcggagaactcaagaaagcaatcccaccgcactgttgcaaacgttcgatccctcgctcttactcctacctcatctgggacataatcatagcctcctgctactactacgtcgccaccacatacttccctctcctccctcaccctctctcccactgacctctctactgagcctcccattagtgcgtcctaaccggcgtctgggtcatagcccacgagtgcgtccaccacgccatcagcgactgc

SEQ ID NO: 11229 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttctctactgggcctgccaagggtgcgtcctaaccggcgtctgggtcatagcccacgagtgcggccaccacgccttcagcgactac

SEQ ID NO: 11230 - DNA, 348 bp, Artificial
  Mutation in BnaC.FAD2.a introduced by TALE nuclease pair BnFAD2_T01
caggatccatgggtgcatgtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 11231 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtcggaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 11232 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagggcggccaccacgccttcagcgactac

SEQ ID NO: 11233 - DNA, 355 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctttggcctctctactgggcctgccaagggtgcgtcctaaccggcgtctgggtcatagcccacgagtgcggccaccacgccttcagcgactac

SEQ ID NO: 11234 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtccccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 11235 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagaccacgagtgcggccaccacgccttcagcgactac

SEQ ID NO: 11236 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatcgcccacgaatgcggccaccacgccttcagcgactac

SEQ ID NO: 11237 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgggcctctctactgggcctgccaagggtgcgtcctaaccggcgtctgggtcatagcccacgagtgcggccaccacgccttcagcgactac

SEQ ID NO: 11238 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 11239 - DNA, 346 bp, Artificial
  Mutation in BnaC.FAD2.a introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaaccggcgtctgggtcatagcccacgagtgcggccaccacgccttcagcgactac

SEQ ID NO: 11240 - DNA, 418 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttagccgtagttaggccaccacttcaagaactctgtagcaccgcctacatacctcgctctgctaatcctgttacctggcccctctactgggcctgccaaggctgcgtcctaacgggcctctgggtcatagcccacgagtgcggccaccacgccttcagcgactac

SEQ ID NO: 11241 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccagcacgccttcagcgactac

SEQ ID NO: 11242 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggccatcatcatagcctcctgcttctactacgtcgccaccacttacttccctctcctccctctccctccccccggcctctctactgggcctgccaagggtgcgtcctaaccggcgtctgggtcatagcccacgagtgcggccaccacgccttcagcgactac

SEQ ID NO: 11243 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcccctctactgggcctgccaagggtgcgtcctaaccggcgtctgggtcatagcccacgagtgcggccaccacgccttcagcgactac

SEQ ID NO: 11244 - DNA, 338 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccatgggtgcgtcctaaccggcgtcggggtcatagcccacgagtgcggccaccacgccttcatcgactac

SEQ ID NO: 11245 - DNA, 347 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgacta

SEQ ID NO: 11246 - DNA, 351 bp, Artificial
  Mutation in BnaC.FAD2.a introduced by TALE nuclease pair BnFAD2_T01
caggatccatgggtgcaggtggaagaatgcaagtgtctcatccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgtggcctctctactgggcctgccaagggtgcgtcctaaccggcgtctgggtcatagcccacgagtgcggccaccacgccttcagcgactac

SEQ ID NO: 11247 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctatctcatctgggacatcatcatagcctcctgcttctactacgtcgccaccacttacttccctctcctccctcaccctctctcctacttcgctgccaagggtgcgtcctaaccggcgtctgggtcatagcccacgagtgcggccaccacgccttcagcgactac

SEQ ID NO: 11248 - DNA, 354 bp, Artificial
  Mutation in BnaC.FAD2.a introduced by TALE nuclease pair BnFAD2_T01
caggatccatgggtgcagggggaagaatgcaagtgtctcctccctccaagaagtctgaaaccgacaccatcaagcgcgtaccctgcgagacaccgcccttcactgtcggagaactcaataaagcaatcccaccgcactgtttcaaacgctcgatccctcgctctttctcctacctcatctgggacatcatcatagcctcctgcttctactacgtcgccaccacttacttccctctcctccctcaccctctctcctactgcgtggtagcctctctactgggcctgccaagggtgcgtcctaaccggcgtctgggtcatagcccacgagggcggctaacacgccttcagcgactac

SEQ ID NO: 11249 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaacacgccttcagcgactac

SEQ ID NO: 11250 - DNA, 388 bp, Artificial
  Mutation in BnaC.FAD2.a introduced by TALE nuclease pair BnFAD2_T01
caggatccatgggtgcaggtgcaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcggtccagcgcctgcttgccaccattattgctggcgatggccaccacctgctgggcctgccaaggctgcgtcctaacgggcctctgggtcatagcccacgagtgcggccaccacgccttcagcgactac

SEQ ID NO: 11251 - DNA, 347 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccacaacttacttccctctcctccctcaccctctctcctactggcctctctactgggcctgccaagggtgcgtcctaaccggcgtctgggtcatagcccgcgagtgcggccaccacgccttcagcgactac

SEQ ID NO: 11252 - DNA, 344 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaagtgtgcgtcctaaccggcgtctgggtcatagcccacgagtgcggccaccacgccttcagcgactac

SEQ ID NO: 11253 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcctacgagtgcggccaccacgccttcagcgactac

SEQ ID NO: 11254 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccgccctggcccctctactgggccggccaaggctgcgtcctaacgggcctctgggtcatcgcccacgaatgcggccaccacgccttcagtgactac

SEQ ID NO: 11255 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtcttaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttggcctctctactgggcctgccaagggtgcgtcctaaccggcgtctgggtcatagcccacgagtgcggccaccacgccttcagcgactac

SEQ ID NO: 11256 - DNA, 357 bp, Artificial
  Mutation in BnaC.FAD2.a introduced by TALE nuclease pair BnFAD2_T01
gcaggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctccctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 11257 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaaggctgcgtcctaacgggcctctgggtcatcgcccacgaatgcggccaccacgccttcagcgactac

SEQ ID NO: 11258 - DNA, 334 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacatcatcaagcgcgtaccctgcgagacaccgcccttcactgtcggagaactcaagaaagcaatcccacctcactgcttcaaacgctcgatccctcgctctttctcctatctcatctgggtcatcatcatagcctcctgtttctaccaccttgccaccacttacttccctctcccccctcaccctctctcctccttcgctgccaagggtgcgtcctaaccggcgtctgggtcatagcccacgagtgcggccaccacgccttcagcgactac

SEQ ID NO: 11259 - DNA, 351 bp, Artificial
  Mutation in BnaC.FAD2.a introduced by TALE nuclease pair BnFAD2_T01
cagggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 11260 - DNA, 321 bp, Artificial
  Mutation in BnaC.FAD2.a introduced by TALE nuclease pair BnFAD2_T01
caggatccatgggtgcaggtggaagaatgcaagtgtctcctccctccaaaaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaaccggcgtctgggtcatagcccacgagtgcggccaccacgccttcagcgactac

SEQ ID NO: 11261 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcgcctggcctctctactgggcctgccaagggtgcgtcctaaccggcgtctgggtcatagcccacgagtgcggccaccacgccttcagcgacta

SEQ ID NO: 11262 - DNA, 347 bp, Artificial
  Mutation in BnaC.FAD2.a introduced by TALE nuclease pair BnFAD2_T01
caggatccatgggtgcaggtggaagaatgcaagtctctcctcactccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctattggcctctctactgggcctgccaagggtgcgtcctaaccggcgtctgggtcatagcccacgagtgcggccaccacgccttcagcgactac

SEQ ID NO: 11263 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactaggtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 11264 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccttggcctctctactgggcctgccaagggtgcgtcctaaccggcgtctgggtcatagcccacgagtgcggccaccacgccgtcagcgactac

SEQ ID NO: 11265 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccctggcctctctactgggcctgccaagggtgcgtcctaaccggcgtctgggtcatagcccacgagtgcggccaccacgccttcagcgactac

SEQ ID NO: 11266 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagagactac

SEQ ID NO: 11267 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctcccctacggcctctctactgggcctgccaagggtgcgtcctaaccggcgtctgggtcatagcccacgagtgcggccaccacgccttagcgactac

SEQ ID NO: 11268 - DNA, 338 bp, Artificial
  Mutation in BnaC.FAD2.a introduced by TALE nuclease pair BnFAD2_T01
caggatccatgggtgcaggtggaagaatgcaagtgtctcctcactccaagaagtctgaaaccgacaccatccagcgcgtaccctgcgagacaccgcccttcactgtcggagaactcaagaaagcaatcccaccgcactgtttcaaacgctcgatccctcgctctttctcctacctcatctgggacatcatcatagcctcctgtttctactacgtcgccaccacttacttccctctcctccctcaccctctctctctctactgggcctgccaagggtgcgtcctaaccggcgtctgggtcatagcccacgagtgcggccaccacgccttcagcgactac

SEQ ID NO: 11269 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaaggctgcgtcctaacgggcctctgggtcatagcccacgagtgcggccaccacgccttcagcgactac

SEQ ID NO: 11270 - DNA, 312 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgtttcaaacgctcgatccctcgctctttctcctacctcatctgggacatcatcatagcctcctgcttctactacgtcgccaccacttacttccctctcctcccttaccctgtgcgtcctaaccggcgtctgggtcatagcccacgagtgcggccaccacgccttcagcgactac

SEQ ID NO: 11271 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggctgcgtcctaacgggcctctgggtcatcacccacgaatgcggccaccacgccttcagcgactac

SEQ ID NO: 11272 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaacgggcctctgggtcatcgcccacgaatgcggccaccacgccttcagcgactac

SEQ ID NO: 11273 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtcctaaccggcgtctgggtcatagcccacgagtgcggccaccacgccttcagcgactac

SEQ ID NO: 11274 - DNA, 404 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctatctcggatttgtcctactcaggagagcgttcaccgacaaacaacagataaaacgaaaggcccgcctggcctctctactgggcctgccaagggtgcgtcctaaccggcgtctgggtcatagcccacgagtgcggccaccacgccttcagcgactac

SEQ ID NO: 11275 - DNA, 344 bp, Artificial
  Mutation in BnaC.FAD2.a introduced by TALE nuclease pair BnFAD2_T01
caggatccatgggtgcaggtggaagaatgcaagtgtctcctccctccaacacgtctgaaaccgacaccatcaaacgcgtaccctgcgagacaccacccttcactgtcggagaactcaagaaagcaatcccaccccactgtttcaaacgctccatccctcgctccttctcctacctcatctggcacatcatcataccctcctgcttctaccacttccccaccacttacttccctctcctccctcaccccctctcctggcccctctactgggcctgccaaggctgcgtcctaacgggcgtctgggtcatagcccacgagtgcggccaccacgccttcagcgactac

SEQ ID NO: 11276 - DNA, 401 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccataacctgccaggcatcaaactaagcagaaggccatccgtccataggctggcctctctactgggcctgccaagggtgcgtcctaaccggcgtctgggtcatagcccacgagtgcggccaccacgccttcagcgactac

SEQ ID NO: 11277 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgcctgcagcgactac

SEQ ID NO: 11278 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccttggcctctctactgggcctgccaagggtgcgtcctaaccggcgtctgggtcatagcccacgagtgcggccaccacgccttcagcgactac

SEQ ID NO: 11279 - DNA, 338 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactactgggccagccaagggggcgtcctaacgggcctctgggtgatagcccacgagtgctgccaccacgccttcagcgactac

SEQ ID NO: 11280 - DNA, 338 bp, Artificial
  Mutation in BnaC.FAD2.a introduced by TALE nuclease pair BnFAD2_T01
caggatccatgggtgcaggtgcaagaatgcaagtgtctcctccatacaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcctgccaagggtgcgtcctaaccggcgtctgggtcatagcccacgagtgcggccaccacgccttcagcgactac

SEQ ID NO: 11281 - DNA, 324 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgccctccactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcgccaagggtgcgtcctaaccggcgtctgggtcatagcccacgagtgcggccaccacgccttcagcgactac

SEQ ID NO: 11282 - DNA, 348 bp, Artificial
  Mutation in BnaC.FAD2.a introduced by TALE nuclease pair BnFAD2_T01
caggatccatgggtgcaggtggaagaatgcaagtgtctcctccctccaacaagtctgaaaccgacaacctcaagcgcgtaccctgcgagacaccgcccttcactgtcggagaactcaagaaagcaatcccacctcactgtttcaaacgctcgatccctcgctccttctcctacctcatctgggccaccatcatagcctcctgcttctactacctcgcccccacttacctccctctcctccctccccccctctcccacttggcctctctactgggcctgccaagggtgcgtcctaaccggcgtctgggtcatagcccacgagtgcggccaccacgccttcagcgactac

SEQ ID NO: 11283 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaataccaccgcactgtttcaaacgctcgatccctcgctctttctcctacctcatctgggacatcatcatagcctcctgcttctactacgtcgccaccacttacttccctctcctccctcaccctctctcctacatggcctctctactgggcctgccaagggtgcgtcctaaccggcgtctgggtcatagcccacgagtgcggccaccacgccttcagcgactac

SEQ ID NO: 11284 - DNA, 352 bp, Artificial
  Mutation in BnaC.FAD2.a introduced by TALE nuclease pair BnFAD2_T01
caggatccatgggtgcaggtggaagaatgcaagtgtctcctccctcaaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccgccggcctctctactgggcctgccaagggtgcgtcctaaccggcgtctggttcagagcccacgagtgcggccaccacgcctgcagcgactac

SEQ ID NO: 11285 - DNA, 332 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtctgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaaggctgcgtcctaacgggcctctgggtcatagcccacgagtgcggccaccacgccttcagcgactac

SEQ ID NO: 11286 - DNA, 387 bp, Artificial
  Mutation in BnaC.FAD2.a introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgccatcgtggctggcgatggccaccacctgctcctggcctctctactgggcctgccaaggctgcgtcctaacgggcctctgggtcatcgcccacgaatgcggccaccacgccttcagcgactac

SEQ ID NO: 11287 - DNA, 350 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctatctcctacttctggcctctctactgggcctgccaagggtgcgtcctaaccggcgtctgggtcatagcccacgagtgcggccaccacgccttcagcgactac

SEQ ID NO: 11288 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 11289 - DNA, 425 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatacctcgctctttctcctacctcatctgggacatcatcatagcctcctgcttctactacgtcgccaccacttacttccctctcctcccccaccctctcccttaccttgcggatttgaacgttgtgaagcaacggcccggagggtggcgggccaccacctgctggggggtcaagccgtgggcctggcccctctactgggcctgccaaggctgcgtcctaacgggcctctgggtcagcgcccacgaatgcggccaccacgccttcagcgactac

SEQ ID NO: 11290 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaaccggcgtctgggtcagagcccacgaaggcggccaccacgccttcagcgactac

SEQ ID NO: 11291 - DNA, 343 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcggctgggtcatagcccacgagtgcggccaccacgccttcagcgactac

SEQ ID NO: 11292 - DNA, 347 bp, Artificial
  Mutation in BnaC.FAD2.a introduced by TALE nuclease pair BnFAD2_T01
caggatccatgggtgcaggaggaagaatgcaagtgcctcctccctccaaaaagtctgaacccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcggcctaaccggcgtctgggtcatagcccacgagtgcggccaccacgccttcagcgactac

SEQ ID NO: 11293 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttctctctcctccctcaccctctctcctacttcgctgccaagggtgcgtcctaacgggcctctgggtcatagcccacgagtgcggccaccacgccttcagcgactac

SEQ ID NO: 11294 - DNA, 352 bp, Artificial
  Mutation in BnaC.FAD2.a introduced by TALE nuclease pair BnFAD2_T01
cagcaggatccatgggtgcaggtggaagaatgcaagtgactcctccatccaagaagtctgaaaccgacaccatcaagcgcgtaccctgcgagacaccgcccttcactgtcggagaactcaagaaagcaatcccacctcactgcttcaaacgctccatccctcgctccttctcctacctcctctgggacatcatcatagcctcctgcttctactacgtcgccaccacttacttccctctcctccctcaccctctctcctactctggcctctctactgggcctgccaagggtgcttcctaacgggcctctgggtcatagcccacgagtgcggccaccacgccttcagcgactac

SEQ ID NO: 11295 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcggctgggtcatagcccacgagtgcggccaccacgccttcagcgactac

SEQ ID NO: 11296 - DNA, 335 bp, Artificial
  Mutation in BnaC.FAD2.a introduced by TALE nuclease pair BnFAD2_T01
caggatccatgggtgcaggtggaagaatgcaagtgtctcctccctcaaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgtcctaaccggcgtctgggtcatagcccacgagtgcggccaccacgccttcagcgactac

SEQ ID NO: 11297 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctcgatccctcgctccttctcctacctcatctgggacatcatcatagcctcctgcctctactacgtcgccacctcctacttccctctcctccctcaccctctctcctcctctcctctctactgggcctgccaagggtgcgtcctaaccggcgtctgggtcatagcccacgagtgcggccaccacgccttcagcgactac

SEQ ID NO: 11298 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctggtacatcatcatagcctcctgcttctactacgtcgccaccacttacttccctctcctccctcaccctctctcctaactctctactgggcctgccaagggtgcgtcctaaccggcgtctgggtcatagcccacgagtgcggccaccacgccttcagcgactac

SEQ ID NO: 11299 - DNA, 355 bp, Artificial
  Mutation in BnaC.FAD2.a introduced by TALE nuclease pair BnFAD2_T01
caggatccatgggtgcaggtggaagaatgcaagtgtctcctccctacaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcgctggcctctctactgggcctgccaagggtgcgtcctaaccggcgtctgggtcatagcccacgagtgcggccaccacgccttcagcgactac

SEQ ID NO: 11300 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagttcgtccagcacgccttcagcgactac

SEQ ID NO: 11301 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcgagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctggcctctctactgggcctgccaagggtgcgtcctaacgggcctctgggtcatagcccacgagtgcggccaccacgccttcagcgactac

SEQ ID NO: 11302 - DNA, 345 bp, Artificial
  Mutation in BnaC.FAD2.a introduced by TALE nuclease pair BnFAD2_T01
caggatccatgggtgcaggtggaagaatgcaagtgtctcctccctcaaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaaccggcgtctgggtcatagcccacgagtgcggccaccacgccttcagcgactac

SEQ ID NO: 11303 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggtctctctactgggcctgccaagggtgcgtcctaaccggcgtctgggtcatagcccacgagtgcggccaccacgccttcagcgactac

SEQ ID NO: 11304 - DNA, 350 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagtgtgcgtcctaaccggcgtctgggtcatagcccacgagtgcgtccaccacgccttcagcgactac

SEQ ID NO: 11305 - DNA, 348 bp, Artificial
  Mutation in BnaC.FAD2.a introduced by TALE nuclease pair BnFAD2_T01
caggatccatgggtgcaggtgcaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcccctctactgggcctgccaagggtgcgtcctaaccggcgtctgggtcatagcccacgagtgcggccaccacgcctcagcgactac

SEQ ID NO: 11306 - DNA, 347 bp, Artificial
  Mutation in BnaC.FAD2.a introduced by TALE nuclease pair BnFAD2_T01
caggatccatgggtgcaggtggaagaatgcaagtgtcacctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccgtcagcgactac

SEQ ID NO: 11307 - DNA, 348 bp, Artificial
  Mutation in BnaC.FAD2.a introduced by TALE nuclease pair BnFAD2_T01
caggatccatgggtgcaggtgcaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcataccctcctgcttctactccgtcgccaccacttacttccctctcctccctcaccccctcccccacttggcctctctactgggcctgccaagggtgcgtcctaaccggcgtctgggtcatagcccacgagtgcggccaccacgccttcagcgactac

SEQ ID NO: 11308 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctccaacgcgtcccctgcgagacaccaccattcactctcggaaacctcaagaaagcaatcccaccgcactgtttcaaacgctcgatccctcgctctttctcctacctcatctgggacatcatcatagcctcctgcttctactacgtcgccaccacttacttccctctcctccctcaccctctcgcctagcctctctactggtcctgccaagggtgcgtcctaaccggcgtctgggtcatagcccacgagtgtggccaccacgccttcagcgactc

SEQ ID NO: 11309 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaacccgacaccatcaagagcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacctccctctcctccctcaccctctcccctactgctggcctctctactgggcctgccaaggctgcgtcctaacgggcctctgggtcatagcccacgagtgcggccaccacgccttcagcgactac

SEQ ID NO: 11310 - DNA, 348 bp, Artificial
  Mutation in BnaC.FAD2.a introduced by TALE nuclease pair BnFAD2_T01
caggatccatgggtgcagggggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttggcctctctactgggcctgccaagggtgcgtcctaaccggcgtctgggtcatagcccacgagtgcggccaccacgccttcagcgactcc

SEQ ID NO: 11311 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtccgaaccggcgtctgggtcatagcccacgagtgcggccaccacgccttcagcgactac

SEQ ID NO: 11312 - DNA, 347 bp, Artificial
  Mutation in BnaC.FAD2.a introduced by TALE nuclease pair BnFAD2_T01
caggatccatgggtgcaggtggaagaatgcaagtgtctcctccctcaaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttgcctctctactgggcctgccaagggtgcgtcctaaccggcgtctgggtcatagcccacgagtgcggccaccacgccttcagcgactac

SEQ ID NO: 11313 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgtgccctcgctctttctcctacctcatctgggacatcatcatagcctcctgcttctactacgtcgccacctcttgcttccctctcctccctcaccctctctcctacttctcttctgggcctgccaagggtgcctcctaaccggcgtctgagtcacagcccacaagtgcatccaccacgcctgcaacgactac

SEQ ID NO: 11314 - DNA, 357 bp, Artificial
  Mutation in BnaC.FAD2.a introduced by TALE nuclease pair BnFAD2_T01
caggatccatgggtgcaggtggaagaatgcaagtgtctaatccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggtgcctggcctctctactgggccggccaagggtgcgtcctaaccggcgtctgggtcatagcccacgagtgcggccaccacgccttcagcgactac

SEQ ID NO: 11315 - DNA, 343 bp, Artificial
  Mutation in BnaC.FAD2.a introduced by TALE nuclease pair BnFAD2_T01
caggatccatgggtgcaggtggaagaatgcaagtgtctactcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcaggcctctctactgggcctgccaagggtgcttcctaaccggcgtctgggtcatagcccacgagtgcggcctccacgccttcagcgactac

SEQ ID NO: 11316 - DNA, 404 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcttgccgccatcttggctggcgatggccaccacctgctccggggtcaagccgtgggcctctctactgggcctgccaagggtgcgtcctaaccggcgtctgggtcatagcccacgagtgcggccaccacgccttcagcgactac

SEQ ID NO: 11317 - DNA, 355 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctttgtcatagcccacgagtgcggccaccacgccttcatcgactac

SEQ ID NO: 11318 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 11319 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatcccttgctctttctcctacctcatctgggacatcatcatagcctcctgcttctactacgtcgccaccacttactcccctctcctccctcaccctctctcctacttcgcctctctactgggcctgccaagggtgcgtcctaacgggcctctgggtcatagcccacgagtgcggccaccacgccttcagcgactac

SEQ ID NO: 11320 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacactatcaagcgcgtaccctgcgagacaccgcccttcactgtcggagaactcaagaaagcaatcccaccgcactgtttcaaacgctccatcccacgctccttctcctacctcatctgggacatcatcatagcctcctgcttctactacgtcgccaccacttacttccctctcctccctcaccctctctcctacggggcctgccaagagtgcgtcctaaccggcgtctgggtcatagcccacgagtgcggccaccacgccttcagcgactac

SEQ ID NO: 11321 - DNA, 344 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 11322 - DNA, 334 bp, Artificial
  Mutation in BnaC.FAD2.a introduced by TALE nuclease pair BnFAD2_T01
caggatccatgggtgcagggggaagaatgcaagtgtctactccctccaagaagtctgaaaccgacaccatcaagcgcgtaccctgcgagacaccgcccttcactgtcggagaactcaagaaagctatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccacgagtgcggccaccacgccttcagcgactac

SEQ ID NO: 11323 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctccgcctggcccctctactgggcctgccaaggctgcgtcctaacgggcctctgggtcatcgcccacgaatgcggccaccacgccttcagcgactac

SEQ ID NO: 11324 - DNA, 343 bp, Artificial
  Mutation in BnaC.FAD2.a introduced by TALE nuclease pair BnFAD2_T01
caggatccatgggtgcaggaggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaaccggcgtctgggtcatagcccacgagtgcggccaccacgccttcagcgactac

SEQ ID NO: 11325 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctctttctcctacctcatctgggacatcatcatagcctcctgcttctactacgtcgccaccacttacttccctctcctccctcaccctctctcctatggcctctctactgggcctgccaagggtgcgtcctaacgggcctctgggtcatagcccacgagtgcggccaccacgccttcagcgactac

SEQ ID NO: 11326 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttggcctctctactgggcctgccaagtgtgcgtcctaaccggcgtctgggtcatagcccacgagtgcggccaccacgccttcagcgactac

SEQ ID NO: 11327 - DNA, 345 bp, Artificial
  Mutation in BnaC.FAD2.a introduced by TALE nuclease pair BnFAD2_T01
caggatccatgggtgcaggtgcaagaatgcaagtgtctcctccatccaagaagtctgaacccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 11328 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttaaaacgctcgatccctcgctctttctcctacctcatctgggacatcatcatagcctcctgcttctactacgtcgccaccacttacttccctctcctccctcaccctctctcctacgtggcctctctactgggcctgccaagggtgcgtcctaaccggcgtctgggtcatagcccacgagtgcggccaccacgccttcagcgactac

SEQ ID NO: 11329 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcgtccaccacgccttcagcgactac

SEQ ID NO: 11330 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacacaatcaagcgcgtaccctgcgaaacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 11331 - DNA, 409 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcaccaccacttacttccctctcctccctcaccctctctcctacttcgctggagacggtgcaggcgctgttgccggtgctgtgccaggcccacggcttgacccccctggcctctctactgggcctgccaagggtgcgtcctaaccggcgtctgggtcatagcccacgagtgcggccaccacgccttcagcgactac

SEQ ID NO: 11332 - DNA, 332 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctagccggcgtctgggtcatagcccacgagtgcggccaccacgccttcagcgactac

SEQ ID NO: 11333 - DNA, 349 bp, Artificial
  Mutation in BnaC.FAD2.a introduced by TALE nuclease pair BnFAD2_T01
caggatccatgggtgcaggtggaagaatgcaagtgtctcctccctcaaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtcctaaccggcgtctgggtcatagcccacgagtgcggccaccacgccttcagcgactac

SEQ ID NO: 11334 - DNA, 356 bp, Artificial
  Mutation in BnaC.FAD2.a introduced by TALE nuclease pair BnFAD2_T01
caggatccatgggtgcaggtggaagaatgcaagtgtctcgtccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 11335 - DNA, 335 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttagcctgccaagggtgcgtcctaaccggcgtctgggtcatagcccacgagtgcggccaccacgccttcagcgactac

SEQ ID NO: 11336 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 11337 - DNA, 354 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccgcctggcctctctactgggcctgccaagggtgcgtcctaaccggcgtctgggtcatagcccacgagtgcggccaccacgccttcagcgactac

SEQ ID NO: 11338 - DNA, 343 bp, Artificial
  Mutation in BnaC.FAD2.a introduced by TALE nuclease pair BnFAD2_T01
caggatccatgggtgcaggtgcaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 11339 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttggcctctctactgggcctgccaagggtgcgtcctaaccggcgtctgggtcatagcccactagtgcggccaccacgcctgcagcgactac

SEQ ID NO: 11340 - DNA, 349 bp, Artificial
  Mutation in BnaC.FAD2.a introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 11341 - DNA, 354 bp, Artificial
  Mutation in BnaC.FAD2.a introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccgcctggcctctctactgggcctgccaagggtgcgtcctaaccggcgtctgggtcatagcccacgagtgcggccaccacgcctgcagcgactac

SEQ ID NO: 11342 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcctctgggtcatagcccacgagtgcggccaccacgccttaagcgactac

SEQ ID NO: 11343 - DNA, 378 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctccagcgcctgcttgccgccaccgtggctggcgatggccaccacctgctccggggtcaagccgtgagggctgggtcatagcccacgagtgcggccaccacgccttcagcgactac

SEQ ID NO: 11344 - DNA, 347 bp, Artificial
  Mutation in BnaC.FAD2.a introduced by TALE nuclease pair BnFAD2_T01
caggatccatgggtgcaggtggaagaatgcaagtgtctcctccctacaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 11345 - DNA, 349 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaacgggcctctgggtcatagcccacgagtgcggccaccacgccttcagcgactac

SEQ ID NO: 11346 - DNA, 350 bp, Artificial
  Mutation in BnaC.FAD2.a introduced by TALE nuclease pair BnFAD2_T01
caggatccatgggtgcaggtggaagaatgcaagtctctactccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctacggggcctgccaagggtgcgtcctaaccggcgtctgggtcatagcccacgagtgcggccaccacgccttcagcgactac

SEQ ID NO: 11347 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggtcatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 11348 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcagagcccacgagtgcggccaccacgccttcagcgactac

SEQ ID NO: 11349 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaaggctgcgtcctaacgggcctctgggtcatagcccacgagtgcggccaccacgccttcagcgactac

SEQ ID NO: 11350 - DNA, 378 bp, Artificial
  Mutation in BnaC.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctccagcgcctgcttgccgccatcgtggctggcgatggccaccaccggctccggggtcaagccgtgagggctgggtcatagcccacgagtgcggccaccacgccttcagcgactac

SEQ ID NO: 11351 - DNA, 351 bp, Artificial
  Mutation in BnaC.FAD2.a introduced by TALE nuclease pair BnFAD2_T01
caggatccatgggtgcaggtggaagaatgcaagtgtctcctccctccagaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaaccggcgtctgggtcatagcccacgagtgcggccaccacgccttcagcgactac

SEQ ID NO: 11352 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctggcctctctactgggcctgccaagggtgcgtcctaaccggcctctgggtcatagcccacgagtgcggccagcacgccttcagcgactac

SEQ ID NO: 11353 - DNA, 385 bp, Artificial
  Mutation in BnaC.FAD2.a introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttactcccctctcctccccgtgggcctggcacagcaccggcaacagccgctggaccgtctccagcgcctgcctggcctctctactgggcctgccaagggtgcgtcctaaccggcgtctgggtcatagcccacgagtgcggccaccacgccttcagcgactac

SEQ ID NO: 11354 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccggcctctctactgggcctgccaagggtgcgtcctaaccggcgtctgggtcatagcccacgagtgcggccaccacgcctgcagcgactac

SEQ ID NO: 11355 - DNA, 390 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagtcctcaagaaagcaatcccaccgcactgtttcaaacgctcgatccctcgctctttctcctacatcatctgggacatcatcatagcctcctgcttctactacgtcgccaccacttacttccctctcctccctcaccctctctcctacttgctggcgatggccaccccctgctggggggtcaagccgtgggcggcctctctactgggcctgccaagggtgcgtcctaaccggcgtctgggtcatagcccacgagtgcggccaccacgccttcagcgactac

SEQ ID NO: 11356 - DNA, 335 bp, Artificial
  Mutation in BnaC.FAD2.a introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgtcctaacgggcctctgggtcatagcccacgagtgcggccaccacgccttcagcgactac

SEQ ID NO: 11357 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactc

SEQ ID NO: 11358 - DNA, 337 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 11359 - DNA, 340 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgggcgtcctgcccgccaccctccgggccgttgctgcacaccatcgtggctggcgatggccaccacgccttcagcgactac

SEQ ID NO: 11360 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccgccacgcctgcatcgactac

SEQ ID NO: 11361 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttggcctctctactgggcctgccaagcgtgcgtcctaaccggcgtctgggtcatagcccacgagtgcggccaccacgccttcagcgactac

SEQ ID NO: 11362 - DNA, 330 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctactgccaagggtgcgtcctaacgggcctctgggtcatagcccacgagtgcggccaccacgccttcagccgactac

SEQ ID NO: 11363 - DNA, 312 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagggcggccaccacgcctgcagcgactac

SEQ ID NO: 11364 - DNA, 339 bp, Artificial
  Mutation in BnaC.FAD2.a introduced by TALE nuclease pair BnFAD2_T01
caggatccatgggtgcaggtgaaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccaagggtgcgtcctaaccggcgtcttggtcatagcccacgagtgcggccaccacgccttcagcgactac

SEQ ID NO: 11365 - DNA, 349 bp, Artificial
  Mutation in BnaC.FAD2.a introduced by TALE nuclease pair BnFAD2_T01
caggatccatgggtgcaggtggaagaatgcaagtgtctcctcactccagctcccccggaaccaacaccctcaaacgcgtcccctgcgagacaccaccattcactctcggagacctcaagaaagcaatcccacctcactgcttcaaacgctcgatccctcgctctttctcatacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 11366 - DNA, 390 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcggtggcaagcacctgctggggggtcaagccgtgggcggcctctctactgggcctgccaagggtgcgtcctaaccggcgtctgggtcatagcccacgagtgcggccaccacgccttcagcgactac

SEQ ID NO: 11367 - DNA, 342 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgtttcaaacgctcgatccctcgctctttctcatacctcatctgggacatcatcatagcctcctgcttctactacgtcgccaccacttacttccctctcctccctcaccctctctcctactctctactgggcctgccaagggtgcgtcctaaccggcgtctgggtcatagcccacgagtgcggccaccacgccttcagcgactac

SEQ ID NO: 11368 - DNA, 345 bp, Artificial
  Mutation in BnaC.FAD2.a introduced by TALE nuclease pair BnFAD2_T01
caggatccatgggtgcaggtggaagaatgcaagtgtctactcactccaagaagtctgaaaccgacaccataaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctactcctctctactgggcctgccaagggtgcgtcctaaccgacgtctgtgtcttagcccgcgagtgcgtcctccacgcctgcagccactac

SEQ ID NO: 11369 - DNA, 350 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccgttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctagccggcgtctgggtcatagcccacgagtgcggccaccacgccttcagcgactac

SEQ ID NO: 11370 - DNA, 335 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactgggcctgccaaggctgcgtcctaacgggcctctgggtcatagcccacgagtgcggccaccacgccttcagcgactac

SEQ ID NO: 11371 - DNA, 413 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcccggcggatttgtcctactcaggagagcgttcaccgacaaacaacagataaaacgaaaggcccagtcggcctctctactgggcctgccaagggtgcgtcctaaccggcgtctgggtcatagcccacgagtgcggccaccacgccttcagcgactac

SEQ ID NO: 11372 - DNA, 300 bp, Artificial
  Mutation in BnaC.FAD2.a introduced by TALE nuclease pair BnFAD2_T01
caggatccatgggtgcaggcggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccaagggtgcgtcctaaccggcgtctgggtcatagcccacgagtgcggccaccacgccttcagcgactac

SEQ ID NO: 11373 - DNA, 348 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatcgcccacgaatgcggccaccacgccttcagcgactac

SEQ ID NO: 11374 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcggctgggtcatagcccacgagtgcggccaccacgccttcagcgactac

SEQ ID NO: 11375 - DNA, 441 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccaactggtggccatcgccagccacgatggtggcaagcaggcgctggagacggtccagcggctgttgccggtgctgtgccaggcccacggcttgacccctggcctctctactgggcctgccaagagtgcgtcctaaccggcgtctgggtcatagcccacgagtgcggccaccacgccttcagcgactac

SEQ ID NO: 11376 - DNA, 346 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaaccggcgtctgggtcatagcccacgagtgcggccaccacgccttcagcgactac

SEQ ID NO: 11377 - DNA, 343 bp, Artificial
  Mutation in BnaC.FAD2.a introduced by TALE nuclease pair BnFAD2_T01
caggacccatgggtgcaggtggtagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 11378 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcttccctcaccctctctcctactggcctctctactgggcctgccaagggtgcgtcctaaccggcgtctgggtcatagcccacgagtgcggccaccacgccttcagcgactac

SEQ ID NO: 11379 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccttggcctctctactgggcctgccaagggtgcgtcctaaccggcgtctgggtcatagcccacgagtgcggccaccacgccttcagcgactac

SEQ ID NO: 11380 - DNA, 355 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcgcctggcccctctactgggcctgccaaggctgcgtcctaacgggcctctgggtcatcgcccacgaatgcgtccaccacgccatcaacgactac

SEQ ID NO: 11381 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 11382 - DNA, 346 bp, Artificial
  Mutation in BnaC.FAD2.a introduced by TALE nuclease pair BnFAD2_T01
caggatccatgggtgcaggtggaagaatgcaagtgtctaatccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcctctctactgggcctgccaagggtgcgtcctaaccggcgtctgggtcatagcccacgagtgcggccaccacgccttcagcgactac

SEQ ID NO: 11383 - DNA, 358 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttccctcgcctcgtctggcccctctactgggcctgccaaggctgcgtcctaacgggcctctgggtcatcgcccacgaatgcggccaccacgccttcagcgactac

SEQ ID NO: 11384 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaacgggcctctgggtcatcgcccacgaatgcggccaccacgccttcagcgactac

SEQ ID NO: 11385 - DNA, 346 bp, Artificial
  Mutation in BnaC.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctccctcaccctctctcctatggcctctctactgggcctgccaagggtgcgtcctaaccggcgtctgggtcatagcccacgagtgcggccaccacgccttcagcgactac

SEQ ID NO: 11386 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttgcccctctactgggcctgccaaggctgcgtcctaacgggcctctgggtcatagcccacgagtgcggccaccacgccttcagcgactac

SEQ ID NO: 11387 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgccctgtttcaaacgctcgatccctcgctctttctcctacctcatctgggacatcatcatagcctcctgcctctactacgtcgccaccacttacttccctctcctccctcaccctctctcctacctcggcctctctactgggcctgccaagggtgcgtcctaaccggcgtctgggtcatagcccacgagtgcggccaccacgccttcagcgactac

SEQ ID NO: 11388 - DNA, 334 bp, Artificial
  Mutation in BnaC.FAD2.a introduced by TALE nuclease pair BnFAD2_T01
caggatccatgggtgcaggtggaagaatgcaagtctctcctccctcaagctcccccgaaaccaaaaccctcaaacgcgtcccctgcgagacaccgcccttcactgtcggagaactcaagaaagcaatcccaccgcactgcttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccacgagtgcggccaccacgccttcagcgactac

SEQ ID NO: 11389 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcccctgcttctactacgtcgccaccacttacttccctctcctccctcaccctctctcctccttcgcccctggcctctctactgggcctgccaaggctgcgtcctaacgggcctctgggtcatagccctcgagtgcggccaccacgccttcagcgactac

SEQ ID NO: 11390 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttcgactacgtcgccaccacttacttccctctcctccctcaccctctctccgacgttggcctctctactgggcctgccaagggtgcgtcctaaccggcgtctgggtcagagcccacgagtgcggccaccacgccttcagcgactac

SEQ ID NO: 11391 - DNA, 385 bp, Artificial
  Mutation in BnaC.FAD2.a introduced by TALE nuclease pair BnFAD2_T01
caggatccatgggtgcaggtggaagaatgcaagtgtctcctacctccaagaagtctgaaaccgacaccatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctccccgtgggcctggcacagcaccggcaacagccgctggaccgtctccagcgcctgcctggcctctctactgggcctgccaagggtgcgtcctaaccggcgtctgggtcatagcccacgagtgcggccaccactccttcagcgactac

SEQ ID NO: 11392 - DNA, 349 bp, Artificial
  Mutation in BnaC.FAD2.a introduced by TALE nuclease pair BnFAD2_T01
caggatccatgggtgcaggtggaagaatgcaagtgtctcatccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgtgtcatagcccacgagtgcggccaccacgccttcagcgactac

SEQ ID NO: 11393 - DNA, 312 bp, Artificial
  Mutation in BnaC.FAD2.a introduced by TALE nuclease pair BnFAD2_T01
caggatccatgggtgcaggtggaagaatgcaagtctctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgtggccaccacgccttcagcgactac

SEQ ID NO: 11394 - DNA, 387 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgccatcgtggctggcgatggccaccacctgctcctggcctctctactgggcctgccaagggtgcgtcctaaccggcgtctgggtcatagcccacgagtgcggccaccactccttcagcgactac

SEQ ID NO: 11395 - DNA, 319 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatcccacgctccttctcctcttcgacatcatcatctcctcctcggctcctccctcaccctctctcctacttcgcgcctggcctctctactgggcctgccaagggtgcgtcctaaccggcgtctgggtcatagcccacgagtgcggccaccacgccttcagcgactac

SEQ ID NO: 11396 - DNA, 344 bp, Artificial
  Mutation in BnaC.FAD2.a introduced by TALE nuclease pair BnFAD2_T01
caggatccatgggtgcaggtggaagaatgtaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 11397 - DNA, 338 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcctgccaagggtgcgtcctaaccggcgtctgggtcatagcccacgagtgcggccaccacgccttcagcgactac

SEQ ID NO: 11398 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccaacttggcctctctactgggcctgccaagggtgcgtcctaaccggcgtctgggtcatagcccaccagtgcggccaccacgccttctgcgactac

SEQ ID NO: 11399 - DNA, 300 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccaaggctgcgtcctaacgggcctctgggtcatagcccacgagtgcggccaccacgccttcagcgactac

SEQ ID NO: 11400 - DNA, 348 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttcgcctctctactgggcctgccaagggtgcgtcctaaccggcgtctgggtcatagcccacgagtgcggccaccacgccttcagcgactac

SEQ ID NO: 11401 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccggaaccgacaccatcaagcgcgtaccctgcgagacaccgcccttcactgtcggagaactcaagaaagcaatcccaccgcactgtttcaaacgctcgctccctcgctctttctcctacctcatctgggacatcatcatagcctcctgcttctactacgtcgccaccacttacttccctctcctccctcaccctctcgccagcttctctactgggcctgccaagggtgcgtcctaaccggcgtctgggtcatagcccacgagtgcggccaccacgccttcagcgactac

SEQ ID NO: 11402 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 11403 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcacctactcctctctactgggccggccaagggtgcgtcctaaccggcgtctgggtcatagcccacgagtgcggccaccacgccttcagcgactac

SEQ ID NO: 11404 - DNA, 351 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccctggcctctctactgggcctgccaagggtgcggcctaaccggcgtctgggtcatagcccacgagtgcggccaccacgccttcagcgactac

SEQ ID NO: 11405 - DNA, 300 bp, Artificial
  Mutation in BnaC.FAD2.a introduced by TALE nuclease pair BnFAD2_T01
caggatccatgggtgcaggtggaagaatgcaattgtctcctacctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccaagggtgcgtcctaaccggcgtctgggtcatagcccacgagtgcggccaccacgccttcagcgactac

SEQ ID NO: 11406 - DNA, 415 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggagacgatggccaccacctgctggggggtcaagttgagcggggcacccgtcagtgcatgcatggcctctctactgggcctgccaagggtgcgtcctaaccggcgtctgggtcatagcccacgagtgcggccaccacgccttcagcgactac

SEQ ID NO: 11407 - DNA, 387 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgccgccatcgtggctggcgatggccaccacctgctcctggcctctctactgggcctgccaagggtgcgtcctaaccggcgtctgggtcatagcccacgagtgcggccaccacgccttcagcgactac

SEQ ID NO: 11408 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacacaatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttctggcctctctactgggcctgccaagggtgcgtcctaaccggcgtctgggtcagagcccacgagggcggccggcaggccttcagcgactac

SEQ ID NO: 11409 - DNA, 404 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacctcgcttgccgccagcgtggctggcgatggccaccacctgctccggggtcaagccgtgggcctctctactgggcctgccaagggtgcgtcctaaccggcgtctgggtcatagcccacgagtgcggccaccacgccttcagcgactac

SEQ ID NO: 11410 - DNA, 348 bp, Artificial
  Mutation in BnaC.FAD2.a introduced by TALE nuclease pair BnFAD2_T01
caggatccatgggtgcaggtggaagaatgcaagtgtcccctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatggcctctctactgggcctgccaagggtgcgtcctaaccgtcggctgggtcctagcccacgagtgcggccaccacgccagcagcgactac

SEQ ID NO: 11411 - DNA, 318 bp, Artificial
  Mutation in BnaC.FAD2.a introduced by TALE nuclease pair BnFAD2_T01
caggatccatgagtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcaccaccacttggcaggcctctctactgggcctgccaagggtgcgtcctaacgggcctctgggtcatcgcccacgaatgcggccaccacgccttcagcgactac

SEQ ID NO: 11412 - DNA, 344 bp, Artificial
  Mutation in BnaC.FAD2.a introduced by TALE nuclease pair BnFAD2_T01
caggatccatgggtgcaggtggaagaatgcaagtctctcctccctccagctcccccggaaccacccccctcaaacgctccccctgcgagccacccccattccctctcggagacctcaagaaaccaatcccaccgcactgttccaaacgctcgatccctcgctctttctcctacctcatctgggacatcatcatagcctcctgcttctactccgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 11413 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgagtcatagcccacgagtgcggccaccacgcctgcagcgactac

SEQ ID NO: 11414 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccgctggcctctctactgggcctgccaagggtgcgtcctaaccggcgtctgggtcatagcccacgagtgcggccaccacgccttcagcgactac

SEQ ID NO: 11415 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaacgggcctctgggtcatagcccacgagtgcggccaccacgccttcagcgactac

SEQ ID NO: 11416 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatctcctcctcggctcctccctctaccacctctccacagcctacttccctctcctccctcaccctctctcctgcctggcctctctactgggcctgccaagggtgcgtcctaaccggcgtctgggtcatagcccacgagtgcggccaccacgccttcagcgactac

SEQ ID NO: 11417 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaaccggcgtctgggtcatagcccacgagggcggccaccacgccttcagcgactac

SEQ ID NO: 11418 - DNA, 332 bp, Artificial
  Mutation in BnaC.FAD2.a introduced by TALE nuclease pair BnFAD2_T01
caggatccatgggtgcaggtggaagaacgcaagtctctcctccctccagctcccccggaaccgacaccatcaagcgcgtaccctgcgagacaccgcccttcactgtcggagaactcaagaaagcaatcccaccacactgtttcaaacgctcgatccctcgctccttctcctacctcatctgggacatcatcatagcctcctgcttctactacgtcgccaccacttacttccctctcctccctcagcctctctactgggcctgccaagggtgcgtcctaaccggcgtctgggtcatagcccacgagtgcggccaccacgccttcagcgactac

SEQ ID NO: 11419 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagcgtgcgtcctaaccggcgtctgggtcatagcccacgagtgcggccaccacgccttcagcgactac

SEQ ID NO: 11420 - DNA, 348 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctctaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 11421 - DNA, 348 bp, Artificial
  Mutation in BnaC.FAD2.a introduced by TALE nuclease pair BnFAD2_T01
caggatccatgggttgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatatcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 11422 - DNA, 329 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgactgccaagggtgcgtcctaacgggcgtctgggtcatagcccacgagtgcggccaccacgccttcagcgactac

SEQ ID NO: 11423 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactggggctgccaagggtgcgtcctaaccggcgtctgggtcatagcccacgagtgcggccaccacgccatcagcgactac

SEQ ID NO: 11424 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctggttctactacgtcgccaccacttacttccctctcctccctcaccctctctcctacttcgccctctctactgggcctgccaagggtgcgtcctaaccggcgtctgggtcatagcccacgagtgcggccaccacgccttcagcgactac

SEQ ID NO: 11425 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggcccccacgccttcagcgactac

SEQ ID NO: 11426 - DNA, 348 bp, Artificial
  Mutation in BnaC.FAD2.a introduced by TALE nuclease pair BnFAD2_T01
caggatccatgggtgcatgtggaagaatgcaagtctctcctccctccagctcccccgaaaccaaaaccctcaaacgcgtcccctgcgagacaccacccttcactctcgaagacctcaagaaagcaatcccaccgcactgtttcaaacgctcgatccctcgctctttctcctacctcatctgggacatcatcatagcctcctgcttctactacgtcgccaccacttacttccctcccctccctcaccctctcgcctccgtagcctctctactgggcctgccaagggtgcggcctaacgggcctctgggtcatcgcccacgaatgcgtccaccgcgcctgcagcgactac

SEQ ID NO: 11427 - DNA, 349 bp, Artificial
  Mutation in BnaC.FAD2.a introduced by TALE nuclease pair BnFAD2_T01
caggatccatgggtgcaggtggaagaatgctagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 11428 - DNA, 347 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 11429 - DNA, 412 bp, Artificial
  Mutation in BnaC.FAD2.a introduced by TALE nuclease pair BnFAD2_T01
caggatccatgggtgcaggtggaagaatgcaagtgtctcctccctccaagaagtcttaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttccctcgctggagacggtccagcggctgttgccggtgctgtgccaggcccccggcttgaccccggagctcgcccctctactgggcctgccaaggctgcgtcctaacgggcctctgggtcatcgcccacgaatgcggccaccacgccttcagcgactac

SEQ ID NO: 11430 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcagcctctctactgggcctgccaagggtgcgtcctaaccggcgtctgggtcatagcccacgagtgcggccaccacgccttcagcgactac

SEQ ID NO: 11431 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctgcctggcctctctactgggcctgccaagggtgcggcctaaccggcgtctgggtcatagcccacgagtgcggccaccacgccttcagcgactac

SEQ ID NO: 11432 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctggaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 11433 - DNA, 345 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacacccccctgcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccaacgtctctctactgggcctgccaagggtgcgtcctaaccggcgtctgggtcatagcccacgagtgcggccaccccgccttcagcgactac

SEQ ID NO: 11434 - DNA, 300 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccaagggtgcgtcctaaccggcgtctgggtcatagcccacgagtgcggccaccacgccttcagcgactac

SEQ ID NO: 11435 - DNA, 351 bp, Artificial
  Mutation in BnaC.FAD2.a introduced by TALE nuclease pair BnFAD2_T01
caggatccatgggtgcaggtggaagaatgcaagtgtctacaccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccatggctgcgtcctaaccggcgtctgggtcatagcccacgagtgcgtccaccacgcctgcagcgactac

SEQ ID NO: 11436 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtagccaccacttacttccctctcctccctcaccctctctcctacttagcctctctactgggcctgccaagggtgcgtcctaagcggcgtctgggtcatagcccacgagtgcggccaccacgcctgctgcgactac

SEQ ID NO: 11437 - DNA, 387 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgccatcgtggctggcgatggccaccacctgctcctggcctctctactgggcctgccaagggtgcgtcctaaccggcgtctgggtcatagcccacgagtgcggccaccacgccttcagcgactac

SEQ ID NO: 11438 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttggcccctctactgggcctgccaaggctgcgtcctaacgggcctctgggtcatcgcccacgaatgcggccaccacgccttcagcgactac

SEQ ID NO: 11439 - DNA, 344 bp, Artificial
  Mutation in BnaC.FAD2.a introduced by TALE nuclease pair BnFAD2_T01
caggatccatggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaaccggcgtctgggtcatagcccacgagtgcggccaccacgccttcagcgactac

SEQ ID NO: 11440 - DNA, 345 bp, Artificial
  Mutation in BnaC.FAD2.a introduced by TALE nuclease pair BnFAD2_T01
caggatcatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 11441 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcgcctctctactgggcctgccaagggtgcgtcctaaccggcgtctgggtcatagcccacgagtgcggccaccacgccttcagcgactac

SEQ ID NO: 11442 - DNA, 348 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgccctttctcctacctcatctgggacatcatcatagcctcctgcttctactacgtcgccaccacttacttccctctcctccctcaccctctctcctccgtaggcctctctactgggccttccaagggagcgtccgaaccggcggctgggtcatagtccacgagtgcggccaccacgcctgaagcgatta

SEQ ID NO: 11443 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctactctcctctctactgggcctgccaagggtgcgtcctaaccggcgtctgggtcatagcccacgagtgcggccaccacgccttcagcgactac

SEQ ID NO: 11444 - DNA, 357 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggtgcctggcctctctactgggcctgccaagggtgcgtcctaaccggcgtctgggtcatagcccacgagtgcggccaccacgccttcagcgactac

SEQ ID NO: 11445 - DNA, 347 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 11446 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaaccggcgtctgggtcatagcccactagtgcggccaccacgccttcagcgactac

SEQ ID NO: 11447 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtgcctctctactgggcctgccaagggtgcgtcctaaccggcgtctgggtcatagcccacgagtgcggccaccacgccttcagcgactac

SEQ ID NO: 11448 - DNA, 349 bp, Artificial
  Mutation in BnaC.FAD2.a introduced by TALE nuclease pair BnFAD2_T01
caggatccatgggttgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 11449 - DNA, 389 bp, Artificial
  Mutation in BnaC.FAD2.a introduced by TALE nuclease pair BnFAD2_T01
caggatccatgggtgcaggtggaagaatgcaagtctctcctccctccatctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcttgcttctactacgtcgccaccacttacttccctctcctccctcaccacccacgtataaaccgtcgatgccctgctgaatattgaactgaaccaggcgactggcctctctactgggcctgccaagggtgcgtcctaaccggcgtctgggtcatagcccacgagtgcgtccaccgcgcctgcagcgactac

SEQ ID NO: 11450 - DNA, 386 bp, Artificial
  Mutation in BnaC.FAD2.a introduced by TALE nuclease pair BnFAD2_T01
caggatccatgggtgcaggtggaagaatgcaagtctctcctccctcagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgccatcgtggctggcgatggccaccacctgctcctggcctctctactgggcctgccaagggtgcgtcctaaccggcgtctgggtcatagcccacgagtgcggccaccacgccttcagcgactac

SEQ ID NO: 11451 - DNA, 449 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgccaggcccacggcttgaccccggagcaggtggtggccatcgccagcaatggcggtggcaagcaggcgctggagacggtccagcggctgttgccggtgctggcctctctactgggcctgccaagggtgcgtcctaaccggcgtctgggtcatagcccacgagtgcggccaccacgccttcagcgactac

SEQ ID NO: 11452 - DNA, 398 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgccaacttctcaagattgcaaaacgtggctgcgtgaccgcagtggaggcagtgcatgcgcctctctactgggcctgccaagggtgcgtcctaaccggcgtctgggtcatagcccacgagtgcggccaccacgccttcagcgactac

SEQ ID NO: 11453 - DNA, 277 bp, Artificial
  Mutation in BnaC.FAD2.a introduced by TALE nuclease pair BnFAD2_T01
caggatccatgggtgcaggtggaagaatgcatgtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacgccttcagcgactac

SEQ ID NO: 11454 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcctagcctcctgcttctactacgtcgccaccacttacttccctctcctccctcaccctctctcctatggcctctctactgggcctgccaagggtgcgtcctaacgggcctctgggtcatagcccacgagtgcggccaccacgccttcagcgactac

SEQ ID NO: 11455 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagctcacgagtgcggccaccacgccttcagcgactac

SEQ ID NO: 11456 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcctctgggtcatcgcccacgaatgcggccaccacgccttcagcgactac

SEQ ID NO: 11457 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtctggcctctctactgggcctgccaagggtgcgtcctaaccggcgtctgggtcatagcccacgagtgcggccaccactccttcagcgactac

SEQ ID NO: 11458 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 11459 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttggcctctctactgggcctgccaagggtgcgtcctaacgggcctctgggtcatagcccacgagtgcggccaccacgccttcagcgactac

SEQ ID NO: 11460 - DNA, 312 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacagcatcaagcgcgtaccctgcgagacaccgcccctcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 11461 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgcctggagcgactac

SEQ ID NO: 11462 - DNA, 348 bp, Artificial
  Mutation in BnaC.FAD2.a introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 11463 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactactttcctctctactgggcctgccaagggtgcgtcctaaccggcgtctgggtcatcgcccacgaatgcggccaccacgccttcagcgactac

SEQ ID NO: 11464 - DNA, 356 bp, Artificial
  Mutation in BnaC.FAD2.a introduced by TALE nuclease pair BnFAD2_T01
caggatccatgggtgcaggtggaagaatgcaagtttctccttccttcaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctggtacatcatcatagcctcctgcttctactacgtcgccaccacttacttccctctcctccctcaccccctctcctacttcgccgcctggcctctctactgggcctgccaagggtgcgtcctaaccggcgtctgggtcatagcccaccagtgcggccaccacgcctgcagcgactac

SEQ ID NO: 11465 - DNA, 419 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcaggcgctgttgccggtgctgtgccaggcccacggcttgaccccccagcaggtggtggccatcgccagatggcctctctactgggcctgccaagggtgcgtactaaccggcgtctgggtcatagcccacgagtgcggccaccacgccttcagcgactac

SEQ ID NO: 11466 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcatctggcacatcatcatagcctcctgcttctactacgtcgcccccacttacttccctctcctccctcaccctctctcccacgtctggcctctctactgggcctgccaaggctgcgtcctaacgggcctctgggtcatagcccacgagtgcggccaccacgccttcagcgactac

SEQ ID NO: 11467 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttcgcctggcctctctactgggcctgccaagggtgcgtcctaacgggcctctgggtcatcgcccacgaatgcggccaccacgccttcagcgactac

SEQ ID NO: 11468 - DNA, 403 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggatacctgtccgcctttctcccttcgggaagcgtggcgctttctcatagctcaggcctctctactgggcctgccaagggtgcgtcctaaccggcgtctgggtcatagcccacgagtgcggccaccacgccttcagcgactac

SEQ ID NO: 11469 - DNA, 348 bp, Artificial
  Mutation in BnaC.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacatggcctctctactgggcctgccaagggtgcgtcctaaccggcgtctgggtcatagcccacgagtgcggccaccacgccttcagcgactac

SEQ ID NO: 11470 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcctctgggtcatagcccacgagtgcggccaccacgccttcagcgactac

SEQ ID NO: 11471 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgttccaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 11472 - DNA, 351 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccaagggtgcgtcctaaccggcgtctgggtcatagcccacgagtgcggccaccacgccttcagcgactac

SEQ ID NO: 11473 - DNA, 346 bp, Artificial
  Mutation in BnaC.FAD2.a introduced by TALE nuclease pair BnFAD2_T01
caggatccatggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 11474 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggtcatcatcatagcctcctgcttctactacgtcgccaccacttacttccctctcctccctcaccctctctcctgcctctctactgggcctgccaagggtgcgtcctaaccggcgtctgggtcatagcccacgagtgcggccaccacgccttcagcgactac

SEQ ID NO: 11475 - DNA, 343 bp, Artificial
  Mutation in BnaC.FAD2.a introduced by TALE nuclease pair BnFAD2_T01
caggatccatgggtgcaggtggaagaatgcaagtgtcacctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacataatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcggcgactac

SEQ ID NO: 11476 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcaatccctcgctctttctcctacctcatctgggacatcatcatagcctcctgcttctactacgtcgccaccacttacttccctctcctccctcacccgctctccgacgtggcctctctactgggcctgccaagggtgcgtcctaaccggcgtctgggtcatagcccacgagtgcggcaaccacgccttcagcgactac

SEQ ID NO: 11477 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctacggggcctgccaagggtgcgtcctaacgggcctctgggtcatagcccacgagtgcggccaccacgccttcagcgactac

SEQ ID NO: 11478 - DNA, 389 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccacccacgtataatccgtcgatgccctgctgaatattgagctgaaccaggcgactggcctctctactgggcctgccaagggtgcgtcctaaccggcgtctgggtcatagcccacgagtgcggccaccacgccttcagcgactac

SEQ ID NO: 11479 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaacaggcgtctgggtcatagcccacgagtgcggccaccacgccttcagcgactac

SEQ ID NO: 11480 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttctggcctctctactgggcctgccaagggtgcgtcctaacgggcctctgggtcctcgcccacgaatgcggccaccacgccttcagcgactac

SEQ ID NO: 11481 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 11482 - DNA, 401 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccataaactgccaggcatcaaactaagcagaaggccatccgtccataggctgacctctctactgggcctgccaagggtgcgtcctaaccggcgtctgggtcatagcccacgagtgcggccaccacgccttcagcgactac

SEQ ID NO: 11483 - DNA, 329 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctactgcttctactacgtcgccaccacttacttccctctcctccctcaccctctctcctactgccaagggtgcgtcctaaccggcgtctgggtcatagcccacgagtgcggccaccacgccttcagcgactac

SEQ ID NO: 11484 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaacgggcctctgggtcatagcccacgagtgcggccaccacgccttcagcgactac

SEQ ID NO: 11485 - DNA, 473 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgagtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccagtctcatactcactctcaatccaaataatctgcaccgtatctcgccctatcagccgttcccagctggtgaagtccgagctggaggagaagaataatggtggcaagcaggcgctggagtccctggcctctctactgggcctgccaagggggcgtcctaaccggcgtctgggtcatagcccacgagtgcggccaccacgccttcagcgactac

SEQ ID NO: 11486 - DNA, 348 bp, Artificial
  Mutation in BnaC.FAD2.a introduced by TALE nuclease pair BnFAD2_T01
caggatccatgggtgtaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccgcctggcctctctactgggcctgccaagggtgcgtcctaaccggcgtctgggtcatagcccacgagtgcggccaccacgccttcagcgactac

SEQ ID NO: 11487 - DNA, 324 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgatacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcgccaagggtgcgtcctaaccggcgtctgggtcatagcccacgagtgcggccaccacgccttcagcgactac

SEQ ID NO: 11488 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttaccctctactgggcctgccaaggctgcgtcctaacgggcctctgggtcatcgcccacgaatgcggccaccacgccttcagcgactac

SEQ ID NO: 11489 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgaggcaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccaagggtgcgtcctaaccggcgtctgggtcatagcccacgagtgcggccaccacgccttcagcgactac

SEQ ID NO: 11490 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 11491 - DNA, 393 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctccctcaccctctctaacggtgcaggcgctgttgccggtgctgtgccaggcccacggcttgacccctggcctctctactgggcctgccaagggtgcgtcctaaccggcgtctgggtcatagcccacgagtgcggccaccacgccttcagcgactac

SEQ ID NO: 11492 - DNA, 351 bp, Artificial
  Mutation in BnaC.FAD2.a introduced by TALE nuclease pair BnFAD2_T01
caggatccatgggtgcaggtggaagaatgcaagtgtctactccctcaaagaagtctgaaaccgacaccataaagcgcgtaccctgcgagacaccgcccttcactgtaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctccccgcctctctactgggcctgccaagagtgcggcctaacctgcgtctgcttcatagcccaccagtgcggccaccacgccttcagcgactcc

SEQ ID NO: 11493 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaagggtgcgtcctaaccggcgtctgggtcatagcccacgagttcgtccaccacgccttcagcgactac

SEQ ID NO: 11494 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaaggctgcgtcctaaccggcgtctgggtcatagcccacgagtgcggccaccacgccttcagcgactac

SEQ ID NO: 11495 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcgtctggcctctctactgggcctgccaagggtgcgtcctaaccggcgtctgggtcatagcccacgagtgcggccaccacgccttcagcgactac

SEQ ID NO: 11496 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaagggtgcgtcctaaccggcgtctgggtcatagcccacgagtgcggccaccacgccttcagcgactac

SEQ ID NO: 11497 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 11498 - DNA, 344 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagccccctgcttctactacgtcgccaccacttacttccctctcctccctcaccctctcgcctggcctctctactgggcctgccaaggctgcgtcctaacgggcctctgggtcatagcccacgagtgcggccaccacgccttcagcgactac

SEQ ID NO: 11499 - DNA, 320 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctccatcccacgctccttctcctcttcgacatcatcatctcctcctcggctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 11500 - DNA, 340 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctactctactgggcctgccaagggtgcgtcctaaccggcgtctgggtcatagcccacgagtgcggccaccacgccttcagcgactac

SEQ ID NO: 11501 - DNA, 351 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctgggcctctctactgggcctgccaagggtgcgtcctaaccggcgtctgggtcatagcccacgagtgcggccaccacgccttcagcgactac

SEQ ID NO: 11502 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcaccgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccatcagcgactac

SEQ ID NO: 11503 - DNA, 305 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctcttcgacatcatcatctcctcctccctctaccacctctccacagcctacttccctctgggtctgccaaggctgcgtcctaacgggcctctgggtcatcgcccacgaatgcggccaccacgccttcagcgactac

SEQ ID NO: 11504 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgccaacttctctctactgggcctgccaagggtgcggcctaaccggcgtctgggtcatagcccacgagtgcggccaccacgccttcagcgactac

SEQ ID NO: 11505 - DNA, 349 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctggcctctctactgggcctgccaagggtgcgtcctaacgggcctctgggtcatcgcccacgaatgcggccaccacgccttcagcgactac

SEQ ID NO: 11506 - DNA, 395 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgccgcaaactcttcctggctagcggtacgcgtattaattgcgtcctggcctctctactgggcctgccaagggtgcgtcctaaccggcgtctgggtcatagcccacgagtgcggccaccacgccttcagcgactac

SEQ ID NO: 11507 - DNA, 342 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcgcctggcctctctactgggcctgccaagggtgcgtcctaaccggcgtctgggtcatagcccacgagtgcggccaccacgccttcagcgactac

SEQ ID NO: 11508 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgacta

SEQ ID NO: 11509 - DNA, 354 bp, Artificial
  Mutation in BnaC.FAD2.a introduced by TALE nuclease pair BnFAD2_T01
caggatccatgggtgcaggtggaagaatgtaagtgtctactcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttcgcctggcctctctactgggcctgccaagggtgcgtcctaaccggcgtctgggtcatagcccaccagtgtgtccaccacgcctgcagcgactac

SEQ ID NO: 11510 - DNA, 346 bp, Artificial
  Mutation in BnaC.FAD2.a introduced by TALE nuclease pair BnFAD2_T01
caggatccatgggtgcaggtggaagaatgcaagtctatcctcactccaagaagtctgaaaccgacaccatcaagagcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgagtgcggccaccacgccttcagcgactac

SEQ ID NO: 11511 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgccgacgtagcctctctactgggcctgccaagggtgcggcctaaccggcgtctgggtcatagcccacaagtgcggccaccgcgccagcagcgactac

SEQ ID NO: 11512 - DNA, 348 bp, Artificial
  Mutation in BnaC.FAD2.a introduced by TALE nuclease pair BnFAD2_T01
caggatccatgggtgcaggtggaagaatgcaagtgtctcatccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 11513 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctagcctctctactggacctgccaagggtgcgtcctaaccggcgtctgggtcatagcccacgagtgcggccaccaagccttcagcgactac

SEQ ID NO: 11514 - DNA, 355 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccatcgctctttctcctacctcatctgggacatcatcatagcctcctgcttctactacgtcgccaccacttacttccctctcctccctcaccctctctcctacttcgccctggcctctctactgggcctgccaagggtgcgtcctaaccggcgtctgggtcatagcccacgagtgcggccaccacgcccttcagcgactac

SEQ ID NO: 11515 - DNA, 378 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactccgcccccagcgcctgcttgccgccatcgtggctggcgatggccaccacctcctccggggtcaagccgtgagggctgggtcatagcccacgagtgcggccaccacgccttcagcgactac

SEQ ID NO: 11516 - DNA, 346 bp, Artificial
  Mutation in BnaC.FAD2.a introduced by TALE nuclease pair BnFAD2_T01
caggatccatgggtgcaggtggaagaatgcaagtgtctccccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 11517 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 11518 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgccgccaccacttacttccctctcctcccccaccctctcccctacgcctggcccctctactgggcctgccaagggtgcgtcctaacgggcctctgggtcatagcccacgagtgcggccaccacgcctgcagcgactac

SEQ ID NO: 11519 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctaccacatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 11520 - DNA, 344 bp, Artificial
  Mutation in BnaC.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgcctgcagcgactac

SEQ ID NO: 11521 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 11522 - DNA, 341 bp, Artificial
  Mutation in BnaC.FAD2.a introduced by TALE nuclease pair BnFAD2_T01
caggatccatgggtgcaggtggaagaatgcaagtgtcccctgcctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcccctccctcaccctctctcctatctctactgggcgtgccaagggtgcggcctaaccggcgtctgtgtcatagcccacgagtgcggccaccgcgtctgcagcgactac

SEQ ID NO: 11523 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcgctgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttagcctgccaagggtgcgtcctaaccggcgtctgggtcatagcccacgagtgcggccaccacgccttcagcgactac

SEQ ID NO: 11524 - DNA, 325 bp, Artificial
  Mutation in BnaC.FAD2.a introduced by TALE nuclease pair BnFAD2_T01
caggatccatgggtgcaggtggaagaatgcaagtgtcacctccctcaaagaagtctgaaaccgacaccatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctctcctacttggcttcgtcctaaccggcgtctgggtcatagcccaccagtgcggccaccacgccttcagcgactac

SEQ ID NO: 11525 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtcggggtcatagcccacgagtgcggccaccgcgccttcagcgactgc

SEQ ID NO: 11526 - DNA, 380 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacagtggtccggcgcacgcgctctggaggcctgcctctctactgggcctgccaagggtgcgtcctaacgggcctctgggtcatagcccacgagtgcggccaccacgccttcagcgactac

SEQ ID NO: 11527 - DNA, 340 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccatcacttacttccctctcctccctcaccctctctcctactctactgggcctgccaagggtgcgtcctaacctgcgtctgggtcatagcccacgagtgcggccaccacgccttctgcgactac

SEQ ID NO: 11528 - DNA, 348 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcggcctaaccggcgtctgggtcatagcccacgagtgcggccaccacgccttcagcgactac

SEQ ID NO: 11529 - DNA, 351 bp, Artificial
  Mutation in BnaC.FAD2.a introduced by TALE nuclease pair BnFAD2_T01
caggatccatgggtgcaggtggaagaatgcaagtatatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaaccggcgtctgggtcatagcgcacgagtgcggccaccgcgccttcagcgactac

SEQ ID NO: 11530 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttgggcctctctactggtcctgccaaggctgcgtcctaacgggcctctgggtcatagcccacgagtgcggccaccacgccttcagcgactac

SEQ ID NO: 11531 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgctggcctctctactgggcctgccaagggtgcgtcctaaccggcgtctgggtcatagcccacgagggcggccaccacgccttcagcgactac

SEQ ID NO: 11532 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttcccctggcccctctactgggcctgccaaggctgcgtcctaacgggcctctgggtcatcgcccacgaatgcggccaccacgccttcagcgactac

SEQ ID NO: 11533 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctggcctctctactgggcctgccaagggtgcgtcctaacgggcctctgggtcatcgcccacgaatgcggccaccacgccttcagcgactac

SEQ ID NO: 11534 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgtggcctctctactgggcctgccaagggtgcgtcctaaccggcgtctgggtcatagcccacgagtgcggccaccacgccttcagcgactac

SEQ ID NO: 11535 - DNA, 344 bp, Artificial
  Mutation in BnaC.FAD2.a introduced by TALE nuclease pair BnFAD2_T01
cagtatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcttggcctctctactgggcctgccaagggtgcgtcctaaccggcgtctgggtcatagcccacgagtgcggccaccacgccttcagcgactac

SEQ ID NO: 11536 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgccctggcccctctactgggcctgccaaggctgcgtcctaacgggcctctgggtcatcgcccacgaatgcggccaccacgccttcagcgactac

SEQ ID NO: 11537 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagtgtgcgtcctaaccggcgtctgggtcatagcccacgagtgcggccaccacgccttcagcgactac

SEQ ID NO: 11538 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccatggcccctctaccgggcctgccatgggtgcgtcctaaccggcgtctgggtcatagcccacgagtgcggccaccacgccttcagcgactac

SEQ ID NO: 11539 - DNA, 341 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctctactgggcctgccaagggtgcgtcctaacgggcctctgggtcatagcccacgagtgcggccaccacgccttcagcgactac

SEQ ID NO: 11540 - DNA, 378 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttcgcctccagcgcctgcttgccgccagcgtggctggcgatggccaccacctgctccggggtcaagccgtgagggctgggtcatagcccacgagtgcggccaccacgccttcagcgactac

SEQ ID NO: 11541 - DNA, 343 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaaccggcgtctgggtcatagcccacgagtgcggccaccacgccttcagcgactac

SEQ ID NO: 11542 - DNA, 345 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaagggtgcgtcctaaccggcgtctgggtcatagcccacgagtgcggccaccacgccttcagcgactac

SEQ ID NO: 11543 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacccgcctggcccctctactgggcctgccaaggctgcgtcctaacgggcctctgggtcatcgcccacgaatgcggccaccacgccttcagcgactac

SEQ ID NO: 11544 - DNA, 277 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacaccttcagcgactac

SEQ ID NO: 11545 - DNA, 350 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaccatcaagcgagtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccgacgtctgggtcatagcccacgagtgcgtccaccacgccttcagcgactac

SEQ ID NO: 11546 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccctggcctctctactgggcctgccaagggtgcgtcctaaccggcgtctgggtcatagcccacgagtgcggccaccacgcattcagcgactac

SEQ ID NO: 11547 - DNA, 324 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcttgccaaggctgcgtcctaacgggcctctgggtcatagcccacgagtgcggccaccacgccttcagcgactac

SEQ ID NO: 11548 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaacaggcgtctgggtcatagcccacgagtgcggccaccacgccttcggcgactac

SEQ ID NO: 11549 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacgtggcctctctactgggcctgccaagggtgcgtcctaaccggcgtctgggtcatagcccacgagtgcggccaccacgccttcagcgactac

SEQ ID NO: 11550 - DNA, 332 bp, Artificial
  Mutation in BnaC.FAD2.a introduced by TALE nuclease pair BnFAD2_T01
caggatccatgggtgcaggtggaagaatgcaagtttctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 11551 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcatgaaagcaatcccaccgcactgtttcaaacgctcgatccctcgctctttctcctacctcatctgggacatcatcatagcctcctgcttctactacgtcgccaccacttacttccctctcctccctcaccctctctcctacttccctctctactgggcctgccaaggctgcgtcctaacgggcctctgggtcatcgcccacgaatgcggccaccacgccttcagcgactac

SEQ ID NO: 11552 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtatgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccaccagtgcggccaccacgccttcagcgactac

SEQ ID NO: 11553 - DNA, 339 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgggtcatagcccacgagtgcggccaccacgccttcagcgactac

SEQ ID NO: 11554 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccacaacttacttccctctcctccctcaccctctctcctacttggcctctctactgggcctgccaagggtgcgtcctaaccggcgtctgggtcatagcccacgagtgaggccaccacgcctgcagcgactac

SEQ ID NO: 11555 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccgccgcactgtttcaaacgctcgatccctcgctctttctcctacctcatctgggacatcatcatagcctcctgcttctactacgtcgccaccacttacttccctctcctccctcaccctctctcatactttggcctctctactgggcctgccaagggtgcgtcctaaccggcgtctgggtcatagcccacgagtgcggccaccacgccttcagcgactac

SEQ ID NO: 11556 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttgcctctctactgggcctgccaagggtgcgtcctaaccggcgtctgggtcatagcccacgagtgcggccaccacgcctgcagcgactac

SEQ ID NO: 11557 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactagcctctctactgggcctgccaagggtgcgtcctaaccggcgtctgggtcatagcctacgagtgcggccaccacgcctacagcgactac

SEQ ID NO: 11558 - DNA, 349 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccaagggtgcgtcctaaccggcgtctgggtcatagcccacgagtgcgtccaccacgccttgagcgactac

SEQ ID NO: 11559 - DNA, 347 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttacctctctactgggcctgccaagggtgcgtcctaaccggcgtctgggtcatagcccacgagtgcggccaccacgccttcagcgactac

SEQ ID NO: 11560 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccatcgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 11561 - DNA, 380 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacagtggtcgggcgcacgcgctctggaggcctgcctctctactgggcctgccaagggtgcgtcctaaccggcgtctgggtcatagcccacgagtgcggccaccacgccttcagcgactac

SEQ ID NO: 11562 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtcctaaccagcgtctgggtcatagcccacgagtgcggccaccacgccttcagcgactac

SEQ ID NO: 11563 - DNA, 346 bp, Artificial
  Mutation in BnaC.FAD2.a introduced by TALE nuclease pair BnFAD2_T01
caggatccatgggtgcaggtggaagaatgcaagtctctcctcactccagctcccccgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgagtgcggccaccacgccttcagcgactac

SEQ ID NO: 11564 - DNA, 354 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggtggcctctctactgggcctgccaaggctgcgtcctaacgggcctctgggtcatagcccacgagtgcggccaccacgccttcagcgactac

SEQ ID NO: 11565 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgaagactgggcctgccaaggctgcgtcctaacgggcctctgggtcatagcccacgagtgcggccaccacgccttcagcgactac

SEQ ID NO: 11566 - DNA, 389 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaccgctcgatccctcgctctttctcctacctcatctgggacatcatcatagcctcctgcttctactacgtcgccaccacttacttccctctcctccctcaccacccacgtataaaccgtcgatgccctgctgaatattgaactgaaccaggcgactggcctctctactgggcctgccaagggggcgtcctaaccggcgtctgggtcatagcccacgagtgcggccaccacgccttcagcgactac

SEQ ID NO: 11567 - DNA, 334 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgagacatcatcatagcctcctgcttctactacgtcgccaccacttacttccctctcctccctcaccctctctctactgggcctgccaagggtgcgtcctaaccggcgtctgggtcatagcccacgagtgcggccaccacgccttcagcgactac

SEQ ID NO: 11568 - DNA, 356 bp, Artificial
  Mutation in BnaC.FAD2.a introduced by TALE nuclease pair BnFAD2_T01
caggatccatgggtgcaggtcgaagaatgcaagtctctcctccctccagctcccccgaaaccaaaaccctcaaacgcgtcccctgcgagacaccacccttcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 11569 - DNA, 313 bp, Artificial
  Mutation in BnaC.FAD2.a introduced by TALE nuclease pair BnFAD2_T01
caggatccatgggtgcaggtggaagaatgcaagtgtctcatccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccgccacgccttcaggcgactac

SEQ ID NO: 11570 - DNA, 343 bp, Artificial
  Mutation in BnaC.FAD2.a introduced by TALE nuclease pair BnFAD2_T01
caggatccatgggtgcaggtggaagaatgcaagtgtctcctcactccaagaagtctgaaaccgacaccatcaagcgagtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctggcctctctactgggcctgccaagggtgcggcctaaccggcgtctgggtcatagcccacgagtgcggccaccacgcctgcagcgactac

SEQ ID NO: 11571 - DNA, 342 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgtctctctactgggcctgccaagggtgcgtcctaaccggcgtctgggtcatagcccacgagtgcggccaccacgccttcagcgactac

SEQ ID NO: 11572 - DNA, 321 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaacgggcctctgggtcatagcccacgagtgcggccaccacgccttcagcgactac

SEQ ID NO: 11573 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctggcacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 11574 - DNA, 338 bp, Artificial
  Mutation in BnaC.FAD2.a introduced by TALE nuclease pair BnFAD2_T01
caggatccatgggtgcaggtggaagaatgcaagtctctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactactgggcctgccaagggtgcgtcctaaccggcgtctgggtcatagcccacgagtgcggccaccacgccttcagcgactac

SEQ ID NO: 11575 - DNA, 355 bp, Artificial
  Mutation in BnaC.FAD2.a introduced by TALE nuclease pair BnFAD2_T01
caggatccatgggtgcaggtcgaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctccctcaccctctctcctccttcgcccctggcctctctactgggcctgccaagggtgcgtcctaaccggcgtctgggtcatagcccacgagtgcggccaccacgccttcagcgactac

SEQ ID NO: 11576 - DNA, 346 bp, Artificial
  Mutation in BnaC.FAD2.a introduced by TALE nuclease pair BnFAD2_T01
caggatccatgggtgccaggtggaagaatgcaagtgtctcctccctccaagaagtctgaaaccgacaccatcacgcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaacctgcgtctgggtcatagcccacgagtgcggccaccgcgccttcagcgactac

SEQ ID NO: 11577 - DNA, 348 bp, Artificial
  Mutation in BnaC.FAD2.a introduced by TALE nuclease pair BnFAD2_T01
catgatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatggcctctctactgggcctgccaagggtgcgtcctaaccggcgtctgggtcatagcccacgagtgcggccaccacgccttcagcgactac

SEQ ID NO: 11578 - DNA, 324 bp, Artificial
  Mutation in BnaC.FAD2.a introduced by TALE nuclease pair BnFAD2_T01
caggatccatgggtgcaggtggaagaatgcaagtgtcacctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcgccaagggtgcgtcctaaccggcgtctgggtcatagcccacgagtgcggcgaccacgccttcagcgactac

SEQ ID NO: 11579 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccaaggctgcgtcctaacgggcctctgggtcatagcccacgagtgcggccacaacgccttcagcgactac

SEQ ID NO: 11580 - DNA, 343 bp, Artificial
  Mutation in BnaC.FAD2.a introduced by TALE nuclease pair BnFAD2_T01
caggatccatgggtgcaggtggaagaatgcaagtgtctcatccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggcgaccacgccttcagcgactac

SEQ ID NO: 11581 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccgccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 11582 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacgttggcctctctactgggcctgccaagggtgcgtcctaaccggcgtctgggtcatagcccacgagtgcggccaccacgccttcagcaactac

SEQ ID NO: 11583 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccctggcctctctactgggcctgccaaggctgcgtcctaacgggcctctgggtcatagcccacgagtgcggccaccacgccttcagcgactac

SEQ ID NO: 11584 - DNA, 348 bp, Artificial
  Mutation in BnaC.FAD2.a introduced by TALE nuclease pair BnFAD2_T01
caggatccatgggtgcaggtggaagaatgcaagtgtctcctccccccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 11585 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctctggcctctctactgggcctgccaaggctgcgtcctaacgggcctctgggtcatagcccacgagtgcggccaccacgccttcagcgactac

SEQ ID NO: 11586 - DNA, 348 bp, Artificial
  Mutation in BnaC.FAD2.a introduced by TALE nuclease pair BnFAD2_T01
caggatccatgggtgcaggtgaaagaatgcaagtctatcccccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagccaacgagtgcggccaccacgccttcagcgactac

SEQ ID NO: 11587 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcgccctctctcctacatggcctctctactgggcctgccaagggtgcgtcctaaccggcgtctggctcatagcccacgagtgcggccaccacgccatgagcgagtac

SEQ ID NO: 11588 - DNA, 329 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgccaagggtgcgtcctaacgggcctctgggtcatcgcccacgaatgcggccaccacgccttcagcgactac

SEQ ID NO: 11589 - DNA, 350 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcctctgggtcatcgcccacgaatgcggccaccacgccttcagcgactac

SEQ ID NO: 11590 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgcccgatccctcgctctttctcctacctcatctgggacatcatcatagcctcctgcttctactacgtcgccaccacttacttccctctcctccctcaccctctctcctacttggcctctctactgggcctgccaagggtgcgtcctaacgggcctctgggtcatagcccacgagtgcggccaccacgccttcagcgactac

SEQ ID NO: 11591 - DNA, 348 bp, Artificial
  Mutation in BnaC.FAD2.a introduced by TALE nuclease pair BnFAD2_T01
caggatccatgggtgcaggtggaagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccaacagcgactac

SEQ ID NO: 11592 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacctacttccctctcctccctcaccctctctactgggcctgccaagggtgcgtcctaaccggcgtctgggtcatagcccacgagtgcggccaccacgccttcagcgactac

SEQ ID NO: 11593 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttccgcctggcctctctactgggcctgccaagggtgcgtcctaaccggcgtctgggtcatagcccacgagtgcggccaccacgccttcagcgactac

SEQ ID NO: 11594 - DNA, 401 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccataaactgccaggcatcaaactaagcagaaggccatccgtccataggctggcctctctactgggcctgccaagggtgcgtcctaaccggcgtctgggtcatagcccacgagtgcggccaccacgccttcagcgactac

SEQ ID NO: 11595 - DNA, 348 bp, Artificial
  Mutation in BnaC.FAD2.a introduced by TALE nuclease pair BnFAD2_T01
caggatccatgggtgcaggtggaagaatgcaagtctctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 11596 - DNA, 346 bp, Artificial
  Mutation in BnaC.FAD2.a introduced by TALE nuclease pair BnFAD2_T01
caggatccatgggtgcagggggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaaggctgcgtcctaaccggcgtctgggtcatagcccacgagtgcggccaccacgccttcagcgactac

SEQ ID NO: 11597 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 11598 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttgcctctctactgggcctgccaagggtgcgtcctaaccggcgtctgggtcatagcccacgagtgcggccaccacgccttcagcgactac

SEQ ID NO: 11599 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctggcctctctactgggcctgccaagggtgcgtccgaacgggcctctgggtcatagcccacgagtgcggccaccacgccttcagcgactac

SEQ ID NO: 11600 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacaacatcatagcctcctgcgtctactacgtcgccaccacttacttccctctcctccctcaccctctctccgacttggcctctctacgcggcctgccaagggtgcgtcctagccggcgtctgggtcatagccctcgggtgcggccaccacgccttttgcgactac

SEQ ID NO: 11601 - DNA, 344 bp, Artificial
  Mutation in BnaC.FAD2.a introduced by TALE nuclease pair BnFAD2_T01
caggatccagggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttctctctactgggcctgccaagggtgcgtcctaacgggcctctgggtcatcgcccacgaatgcggccaccacgccttcagcgactac

SEQ ID NO: 11602 - DNA, 355 bp, Artificial
  Mutation in BnaC.FAD2.a introduced by TALE nuclease pair BnFAD2_T01
caggatccatgggtgcaggtggaagaatgcaagtgtctcatccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccaagggtgcgtccgaaccggcgtctgggtcatagcccacgagtgcggcgaccacgccttcagcgactac

SEQ ID NO: 11603 - DNA, 351 bp, Artificial
  Mutation in BnaC.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcctggcctctctactgggcctgccaagggtgcgtcctaaccggcgtctgggtcatagcccacgagtgcggccaccacgccttcagcgactac

SEQ ID NO: 11604 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttctctactgggcctgccaagggtgcgtcctaaccggcgtctgggtcatagtccacgagtgcggccaccacgccttcagcgactac

SEQ ID NO: 11605 - DNA, 343 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccatacctctctactgggcctgccaagggtgcgtcctaaccggcgtctgggtcatagcccacgagtgcggccaccacgccttcagcgactac

SEQ ID NO: 11606 - DNA, 350 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctgaccggcgtcggggtcatagcccacgagtgcggccaccacgccttcagcgactac

SEQ ID NO: 11607 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttctctctactgggcctgccaagggtgcgtcctaaccggcgtctgggtcatagcccacgagtgcggccaccacgccttcagcgactac

SEQ ID NO: 11608 - DNA, 348 bp, Artificial
  Mutation in BnaC.FAD2.a introduced by TALE nuclease pair BnFAD2_T01
caggatccatgggtgcaggtagaagaatgcaagtctctccaacctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatggcctctctactgggcctgccaagggtgcgtcctaaccggcgtctgggtcatagcccacgagtgcggccaccacgccttcagcgactac

SEQ ID NO: 11609 - DNA, 338 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccacctcactgcttcaaacgctccatccctcgctctttctcctacctcatctgggacatcatcatagcctcctgcttctactacgtcgccaccacttacttccctctcctccctcaccctctctctctctactgggcctgccatgggtgcgtcctaaccggcgtctgggtcatagcccacgagtgcggccaccacgccaacagcgactac

SEQ ID NO: 11610 - DNA, 381 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgctcgccgcagccgaacgaccgagcgcagcgtggcctctctactgggcctgccaagggtgcgtcctaaccggcgtctgggtcatagcccacgagtgcggccaccacgccttcagcgactac

SEQ ID NO: 11611 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccaagggtgcgtcctaaccggcgtctgggtcatagcccacgagtgctgcctccacgccttcagcgactac

SEQ ID NO: 11612 - DNA, 345 bp, Artificial
  Mutation in BnaC.FAD2.a introduced by TALE nuclease pair BnFAD2_T01
cggatccatgggtgcaggtggaagaatgcaagtgtctactccctccaagaagtctgaaaccgacaccatcaagcgcgtaccctgagagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttcctctctactgggccggccaagggtgcgtcctaaccggcgtctggttcatagcccacgagtgcggccaccacgccttcagcgactac

SEQ ID NO: 11613 - DNA, 347 bp, Artificial
  Mutation in BnaC.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 11614 - DNA, 436 bp, Artificial
  Mutation in BnaC.FAD2.a introduced by TALE nuclease pair BnFAD2_T01
caggatccatgggtgcaggtggaagaatgcaagtggcccctccatacaagaagtctgaaaccgacaccatccagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactacgccctggctggcgatgccctccacctgctccgtggtcaagccgttggcctggcatctcggccaaatagttgcgagccaatgagacctgacctctctactgggcctgccaaaggtccgtcctaaccgacgtctggtgcacatccgacaagtgtggcctccgcgcctgcagcgactgc

SEQ ID NO: 11615 - DNA, 312 bp, Artificial
  Mutation in BnaC.FAD2.a introduced by TALE nuclease pair BnFAD2_T01
caggatccatgggtgcaggtgaaagaatgcaagtgtcacccccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtccgaaccggcgtctgggtcatagcccacgagtgctgccaccacgccttcagcgactac

SEQ ID NO: 11616 - DNA, 332 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaaccggcgtctgggtcatagcccacgagtgcggccaccacgccttcagcgactac

SEQ ID NO: 11617 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacacactcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttaccttggcccctctactgggcctgccaagactgcgtcctaactggcctctggttcatcgcccacgaatgcggccaccacgccctcagcgactac

SEQ ID NO: 11618 - DNA, 348 bp, Artificial
  Mutation in BnaC.FAD2.a introduced by TALE nuclease pair BnFAD2_T01
caggatccatgggtgcaggtggaagaatgcaagtgtctcctccctccagaaaccctgaaaccaacaccatcaagcgcgtaccctgcgagacaccacccttcactgtcggagaactcaagaaagcaatcccacctcactgcttcaaacgctcgatccctcgctctttctcctacctcatctgggacatcatcatagcctcctgcttctactacgtcgccaccacttacttccctctcctccctcaccctctctcccacttggcctctctactgggcctgccaagggtgcgtcctaaccggcgtctgggtcatagcccacgagtgcggccaccacgccttcagcgactac

SEQ ID NO: 11619 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcgttggcctctctactgggcctgccaagggtgcgtcctaacgggcctctgggtcatagcccacgagtgcggccaccacgccttcagcgactac

SEQ ID NO: 11620 - DNA, 349 bp, Artificial
  Mutation in BnaC.FAD2.a introduced by TALE nuclease pair BnFAD2_T01
caggatccatgggtgcaggtggaagaatgcaagtgtctcctccctccaaaaagtctgaacccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctccagcttctactacgtcgccaccacttacttccctctcctccctcaccctctctcctacctgggcctctctactgcgcctgccaagggtgcgtcctaaccggcgtctggttcatagcccacgagtgcggccaccatgccttcagcgactac

SEQ ID NO: 11621 - DNA, 348 bp, Artificial
  Mutation in BnaC.FAD2.a introduced by TALE nuclease pair BnFAD2_T01
caggatccatgggtgcaggtagaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 11622 - DNA, 398 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcgccttggcaacgctgcgatcatgtcctcatacttgacagcgacggcccctggcctctctactgggcctgccaagggtgcgtcctaaccggcgtctgggtcatagcccacgagtgcggccaccacgccttcagcgactac

SEQ ID NO: 11623 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 11624 - DNA, 348 bp, Artificial
  Mutation in BnaC.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgtggccaccacgccttcagcgactac

SEQ ID NO: 11625 - DNA, 356 bp, Artificial
  Mutation in BnaC.FAD2.a introduced by TALE nuclease pair BnFAD2_T01
caggatccatgggtgcagggggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgcctccacttacttccctctcctccctcaccctctctcctacttcgccgcctggcctctctactgggcctgccaagggtgcgtcctaaccggcgtctggttcatagcccacgagtgctgccaccacgccttcagcgactac

SEQ ID NO: 11626 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttaccttggcccctctactgggcctgccaaggctgcgtcctaacgggcctctgggtcatcgcccacgaatgctgccaccacgccttcagcgactac

SEQ ID NO: 11627 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatccaaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaagggtgcgtcctaaccggcgtctgggtcatagcccacgagtgcggccaccacgccttcagcgactac

SEQ ID NO: 11628 - DNA, 358 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctccttcgcctaacctggcctctctactgggcctgccaagggtgcgtcctaaccggcgtctgggtcatagcccacgagtgcggccaccacgccttcagcgactac

SEQ ID NO: 11629 - DNA, 312 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacaccatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 11630 - DNA, 323 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctacttctactacgtcgccaccacttacttccctcgagccacccactgggcctgccaatggtgcgtcctaaccggcgtctgggtcatagcccacgagtgcggccaccacgccttcagcgactac

SEQ ID NO: 11631 - DNA, 347 bp, Artificial
  Mutation in BnaC.FAD2.a introduced by TALE nuclease pair BnFAD2_T01
caggatccatgggtgcaggtggaagaatgcaagtgtctcctccccccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaaggctgcgtcctaacgggcctctgggtcatagcccacgagtgcggccacgacgccttcagcgactac

SEQ ID NO: 11632 - DNA, 345 bp, Artificial
  Mutation in BnaC.FAD2.a introduced by TALE nuclease pair BnFAD2_T01
catgatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 11633 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 11634 - DNA, 350 bp, Artificial
  Mutation in BnaC.FAD2.a introduced by TALE nuclease pair BnFAD2_T01
caggatccatgggtgcaggtggaagaatgcaagtgtctcctccctacaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtctggcctctctactgggcctgccaagggtgcgtcctaaccggcgtctgggtcatagcccacgagttctgccaccacgccttcagcgactac

SEQ ID NO: 11635 - DNA, 343 bp, Artificial
  Mutation in BnaC.FAD2.a introduced by TALE nuclease pair BnFAD2_T01
caggatcctgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcaatccctcgctctttctcctacctcatctgggacatcatcatagcctcctgcttctactacgtcgccaccacttacttccctctcctccctcaccctctctcctacctctctaacgggcctgccaagggtgcgtcctaaccggcggctgggtcatagcccacgagtgcggccaccacgccttcagcgactacc

SEQ ID NO: 11636 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctctactgggcctgccaagggtgcgtcctaacgggcctctgggtcatagcccacgagtgcggccaccacgccttcagcgactac

SEQ ID NO: 11637 - DNA, 347 bp, Artificial
  Mutation in BnaC.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 11638 - DNA, 379 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaactgagcctttcgttttatctgttgtttggcggtggcctctctactgggcctgccaaggctgcgtcctaaccggcgtctgggtcatagcccacgagtgcggccaccacgccttgagcaactac

SEQ ID NO: 11639 - DNA, 354 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctccggcttctactacctcgccaccacttacttccctctccgccctcaccctctctcctacttcgccctggcctctccactgggccggccatgggtacgtcctaaccggcgtctggctcacttcccacgagtgcggccaccacgccatcagcaactac

SEQ ID NO: 11640 - DNA, 348 bp, Artificial
  Mutation in BnaC.FAD2.a introduced by TALE nuclease pair BnFAD2_T01
caggatccatggggtgcaggtggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 11641 - DNA, 349 bp, Artificial
  Mutation in BnaC.FAD2.a introduced by TALE nuclease pair BnFAD2_T01
caggatccatgggtgcaggtgcaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtcctaaccggcgtctgggtcatagcccgcgagtgcggccaccacgccttcagcgactac

SEQ ID NO: 11642 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccgccctggcctctctactgggcctgccaagggtgcgtcctaaccggcgtctgggtcatagcccacgagtgcggccaccacgccttcagcgactac

SEQ ID NO: 11643 - DNA, 312 bp, Artificial
  Mutation in BnaC.FAD2.a introduced by TALE nuclease pair BnFAD2_T01
caggatccatgggtgcaggtggaagaatgcaagtgtctcccacctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccgtcagcgactac

SEQ ID NO: 11644 - DNA, 332 bp, Artificial
  Mutation in BnaC.FAD2.a introduced by TALE nuclease pair BnFAD2_T01
caggatccatgggtgcaggtgaaagaatgcaagtgtctcctaccaccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggaactgccaagggtgcgtcctaaccggcgtctggggcacagcccacaagtgcggccaccacgccttcagcgactac

SEQ ID NO: 11645 - DNA, 409 bp, Artificial
  Mutation in BnaC.FAD2.a introduced by TALE nuclease pair BnFAD2_T01
caggatccatgggtgcaggtggaagaatacaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcaaataatgattttattttgactgatagtgacctgttcgttgcaacaaattgatgagctctctactgggcctgccaagggtgcgtcctaaccggcgtctgggtcatagcccacgagtgcggccaccacgccttcagcgactac

SEQ ID NO: 11646 - DNA, 358 bp, Artificial
  Mutation in BnaC.FAD2.a introduced by TALE nuclease pair BnFAD2_T01
caggatccatgggcgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctcgcctggcctctctactgggcctgccaagggtgcgtcctaaccggcgtctgggtcatagcccacgagtgcggccaccacgccttcagcgactac

SEQ ID NO: 11647 - DNA, 387 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgccgccatcgtggctggcgagggccaccacctgctcctggcctctctactgggcctgccaagggtgcgtcctaacgggcctctgggtcatagcccacgagtgcggccaccacgccttcagcgactac

SEQ ID NO: 11648 - DNA, 348 bp, Artificial
  Mutation in BnaC.FAD2.a introduced by TALE nuclease pair BnFAD2_T01
caggatccatgggtgcaggtcgaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctatactgggcctgccaagggtgcgtcctaaccggcgtctgggtcatagcccacgagtgcggccaccacgccttcagcgactac

SEQ ID NO: 11649 - DNA, 385 bp, Artificial
  Mutation in BnaC.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccgtgggcctggcacagcaccggcaacagccgctggaccgtctccagcgcctgcctggcctctctactgggcctgccaagggtgcgtcctaaccggcgtctgggtcatagcccacgagtgcggccaccacgccttcagcgactac

SEQ ID NO: 11650 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgagtaccctgcgagacaccgcccttcactgtcggagaactcacgaaagcactcccaccgcactgtttcaaacgctcgatccctcgctctttctcatacctcatctgggacatcatcatagcctcctgcttctactacgacgccaccacttacttcccactcctccctcaccctctctccgactcctggcctctctactgagccggccaagggtgcgtcctaaccggcgtctggttcagagccctcgaatgctgccaccgcgccatcagcgactac

SEQ ID NO: 11651 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctggtacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 11652 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtctggcctctctactgggcctgccaagggtgcgtcctaaccggcgtctgagtcatagcccacgagtgcggccaccacgccttcagcgactac

SEQ ID NO: 11653 - DNA, 348 bp, Artificial
  Mutation in BnaC.FAD2.a introduced by TALE nuclease pair BnFAD2_T01
gaggatccatgggtgcaggtggaagaatgcaagtgtatcctgcctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgcgcctgccaaggttgcgtcctaaccggcttctggttcacagcccaccagtgcggccaccacgccttcagcgactac

SEQ ID NO: 11654 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaatggcctctctactgggcctgccaagggtgcgtcctaaccggcgtctgggtcatagcccacgagtgcggccaccacgccttcagcgactac

SEQ ID NO: 11655 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctatggcctctctactgggcctgccaagggtgcgtcctaacgggcctctgggtcatcgcccacgaatgcggccaccacgccttcagcgactac

SEQ ID NO: 11656 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgcgcctgccaaggctgcgtcctaacgggcctctgggtcatcgcccacgaatgcggccaccacgccttcagcgactac

SEQ ID NO: 11657 - DNA, 355 bp, Artificial
  Mutation in BnaC.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcccctggcctctctactgggcctgccaaggctgcgtcctaacgggcctctgggtcatagcccacgagtgcggccaccacgccttcagcgactac

SEQ ID NO: 11658 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccatctctcctacttcgcctctctactgggcctgccaagggtgcgtcctaaccggcgtctgggtcatagcccacgagtgcggccaccacgccttcagcgactac

SEQ ID NO: 11659 - DNA, 349 bp, Artificial
  Mutation in BnaC.FAD2.a introduced by TALE nuclease pair BnFAD2_T01
caggatcctgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgagtcatagcccacgagtgcggccaccacgccttcagcgactac

SEQ ID NO: 11660 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaagggtgcgtcctaaccggcgtctgggtcatagcccacgagtgcggccaccacgccttcatcgactac

SEQ ID NO: 11661 - DNA, 253 bp, Artificial
  Mutation in BnaC.FAD2.a introduced by TALE nuclease pair BnFAD2_T01
caggatccatgggtgcaggtggaagaatgcaagtgtctcatccctccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctccctctaccacctctccacagcctacttccctctcccttaccacgccttcagcgactac

SEQ ID NO: 11662 - DNA, 350 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctggcctctctactgggcctgccaagggtgcgtcctaaccggcgtctgggtcatagcccacgagtgcggccaccacgccttcagcgactac

SEQ ID NO: 11663 - DNA, 341 bp, Artificial
  Mutation in BnaC.FAD2.a introduced by TALE nuclease pair BnFAD2_T01
caggatccatgggtgcaggtgaaagaatgcaagtgtctcctccctccaagaagtctgaaaccgacaccatcaagcgcgtaccctgcgagacaccacccttcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 11664 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccatcagcgactac

SEQ ID NO: 11665 - DNA, 346 bp, Artificial
  Mutation in BnaC.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaaggctgcgtcctaacgggcgtctgggtcatagcccacgagtgcggccaccacgccttcagcgactac

SEQ ID NO: 11666 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 11667 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaaggctgcgtcctaacgggcctctgggtcatcgcccacgaatgcggccaccacgccttcagcgactac

SEQ ID NO: 11668 - DNA, 341 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctctactgggcctgccaagggtgcgtcctaaccggcgtctgggtcatagcccacgagtgcggccaccacgccttcagcgactac

SEQ ID NO: 11669 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccctcaagcgcgtaccctgcgagacaccgcccttcactgtcggagaactcaagaaagcaatcccaccgcactgtttcaaacgctcgatccctcgctctttctcctacctcatctgcgacatcatcatagcctcctgcttctactacgtcgccaccacttacttccctctcctccctcaccctctctcctcctggcctctctactgggcctgccaagggtgcgtcctaaccggcgtctgggtcatagcccacgagtgcggccaccacgccttcagcgactac

SEQ ID NO: 11670 - DNA, 346 bp, Artificial
  Mutation in BnaC.FAD2.a introduced by TALE nuclease pair BnFAD2_T01
caggatccatgggtgcaggtggaagaatgcaagtctctcctccctccagctcccccggaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcagagcccacgagtgcggccaccacgccttcagcgactac

SEQ ID NO: 11671 - DNA, 318 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcatctgggacatcatcatagcctcctgcttctactacgtcgccaccacttggcaggcctctctactgggcctgccaagggtgcgtcctaaccggcgtctgggtcatagcccacgagtgcggccaccacgccgtcagcgactac

SEQ ID NO: 11672 - DNA, 356 bp, Artificial
  Mutation in BnaC.FAD2.a introduced by TALE nuclease pair BnFAD2_T01
caggatccatgggtgcaggtggaagaatgcaagtgtatcctccctccaaaaagtctgaaaccgacaccatcaagcgcgtaccctgcgagacaccgcccttcactgtcggagaactcaggaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 11673 - DNA, 334 bp, Artificial
  Mutation in BnaC.FAD2.a introduced by TALE nuclease pair BnFAD2_T01
caggatccatgggtgcaggaagaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccacgagtgcggccaccacgccttcagcgactac

SEQ ID NO: 11674 - DNA, 332 bp, Artificial
  Mutation in BnaC.FAD2.a introduced by TALE nuclease pair BnFAD2_T01
caggatccatgggtgcaggcggaagaatgcaagtgtctcctccctccaaaaagtctgaaaccgacaccatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 11675 - DNA, 338 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactactgggcctgccaagggtgcgtcctaacgggcctctgggtcatagcccacgagtgcggccaccacgccttcagcgactac

SEQ ID NO: 11676 - DNA, 374 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcgtcatagcctcctgcttctactacgtcgccaccacttacttccctctcctccctcaccctctctcctactccaggcttatcttggacaagaagaagatcgctctctactgggcctgccaagggtgcgtcctaaccggcgtcggggtcatagcccacgagtgcggccaccacgccttcagcgactac

SEQ ID NO: 11677 - DNA, 351 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcggggcctctctactgggcctgccaagggtgcgtcctaaccggcgtctgggtcatagcccacgagtgcggccaccacgccttcagcgactac

SEQ ID NO: 11678 - DNA, 349 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtaccctgcgagacaccgcccttcactgtcggagaactcaagaaagcaatcacaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaacgggcctctgggtcatagcccacgagtgcggccaccacgccttcagcgactac

SEQ ID NO: 11679 - DNA, 331 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctccctggcccctctactgggcctgccaaggctgcgtcctaacgggcctctgggtcatagcccacgagtgcggccaccacgccttcagcgactac

SEQ ID NO: 11680 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaacctacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtcctaaccggcgtctgggtcagagcccacgagtgcggccaccacgccttcagcgactac

SEQ ID NO: 11681 - DNA, 345 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcacctactcctctctactgggcctgccaagggtgcgtcctaaccggcgtctgggtcatagcccacgagtgcggccaccacgccttcagcgactac

SEQ ID NO: 11682 - DNA, 401 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggtccagcgcctgcttgccaccattattgctggcgatggccaccacctgctgggcctctctactgggcctgccaagggtgcgtcctaaccggcgtctgggtcatagcccacgagtgcggccaccacgccttcagcgactac

SEQ ID NO: 11683 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttggcctctctactgggcctgccaagggtgcgtcctaaccggcgtctgggtcatagcccacgagtgtggccaccacgccttcagcgactac

SEQ ID NO: 11684 - DNA, 436 bp, Artificial
  Mutation in BnaC.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccctgcctggcgatggccaccccctgctccggggtcaagccgtgggcctggcatctctgccaaatagttgggagccaatgagggcaggcctctctactgggcctgccaagggtgcgtcctaaccggcgtctgggtcatagcccacgagtgcggccaccacgccttcagcgactac

SEQ ID NO: 11685 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 11686 - DNA, 300 bp, Artificial
  Mutation in BnaC.FAD2.a introduced by TALE nuclease pair BnFAD2_T01
caggatccattggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtctctctactgggcctgccaagggtgcgtcctaaccggcgtctgggtcatagcccacgagtgcggccaccacgccttcagcgactac

SEQ ID NO: 11687 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctggcctctctactgggccggcctagggtgcttcctaacgggcctcggggttatctcttgcaaatgctgtgaccacgccatcagcaactac

SEQ ID NO: 11688 - DNA, 348 bp, Artificial
  Mutation in BnaC.FAD2.a introduced by TALE nuclease pair BnFAD2_T01
caggatccatgggtgcaggtgcaagaatgcaagtgtctcctccacccaagaagtctgaaaccgacaccatccagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttggcctctctactgggcctgccaagggtgcgtcctaaccgacgtctgggtcatagcccacgagtgcggcctccacgcctttagcgactac

SEQ ID NO: 11689 - DNA, 345 bp, Artificial
  Mutation in BnaC.FAD2.a introduced by TALE nuclease pair BnFAD2_T01
caggatccatgggtgcaggtggaagaatgcaagtgtctcctgcctccaagaagtctgaaaccgacaccatcaagcgcgtaccctgcgcgacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtcttggtcatagcccacgagtgcggccaccgcgccttcagcgactac

SEQ ID NO: 11690 - DNA, 344 bp, Artificial
  Mutation in BnaC.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttggcctctctactgggcctgccaagggtgcgtcctaacgggcctctgggtcatagcccacgagtgcggccaccacgccttcagcgactac

SEQ ID NO: 11691 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctggttcagagccctcgattgcggccaccacgccttcagcgactac

SEQ ID NO: 11692 - DNA, 346 bp, Artificial
  Mutation in BnaC.FAD2.a introduced by TALE nuclease pair BnFAD2_T01
caggatccatgggtgcaggtggaagaatgcaagtgtatcctacctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccatctctcctatggcccctctactgggcctgccaaggctgcgtcctaacgggcctctgggtcatcgcccacgaatgcggccaccacgccttcagcgactac

SEQ ID NO: 11693 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaacgggcctctgggtcatagcccgcgagtgcggccaccacgccttcagcgactac

SEQ ID NO: 11694 - DNA, 346 bp, Artificial
  Mutation in BnaC.FAD2.a introduced by TALE nuclease pair BnFAD2_T01
caggatccatgggtgcaggttgaagaatgcaagtctctcctcccttcagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcacccgctctcctagggcctctctactgggcctgccaagggtgcgtcctaaccggcgtctgggtcaatgcccgccagtgcggccaccacgccttcagcgactac

SEQ ID NO: 11695 - DNA, 349 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacgttggcctctctactgggcctgccaagggtgcgtccgaaccggcgtctgggtcatagcccacgagtgcggcgaccgcgccttcagcgactac

SEQ ID NO: 11696 - DNA, 401 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggtccagcgcctgcttgccaccattattgctggcgatggccaccacctgctgggcctctctactgggcctgccaagggtgcgtcctaacgggcctctgggtcatagcccacgagtgcggccaccacgccttcagcgactac

SEQ ID NO: 11697 - DNA, 324 bp, Artificial
  Mutation in BnaC.FAD2.a introduced by TALE nuclease pair BnFAD2_T01
caggatccatgggtgcaggcggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcttgccaagggtgcgtcctaacgggcctctgggtcatagcccacgagtgcggccaccacgccttcagcgactac

SEQ ID NO: 11698 - DNA, 350 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccctacccctggcccctctactgggcctgccaaggctgcgtcctaacgggcgtctgggtcatcgcccacgaatgcggccaccacgccttcagcgactac

SEQ ID NO: 11699 - DNA, 390 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttgctggcgatggccaccacctgctggggggtcaagccgtgggcggcctctctactgggcctgccaagggtgcgtcctaaccggcgtctgggtcatagcccacgagtgcggccaccacgccttcagcgactac

SEQ ID NO: 11700 - DNA, 366 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccccccccctcccccctcctccgcctgcctctctactgggccggccaagggtgcgtcctaacgggcctctgggtcatcgcccacgaatgcggccaccacgccttcagcgactac

SEQ ID NO: 11701 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcattatagcctcctgcttctactacgtcgccaccacttacttccctctcctccctcaccctctctcctacttgcctctctactgggcctgccaagggtgtgtcctaaccggcgtctgggtcatagcccacgagtgcggccaccacgccttcagcgactac

SEQ ID NO: 11702 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaagggtgcgtcctaaccggcgtctgggtcatagccctcgagtgcggccaccacgccttcagcgactac

SEQ ID NO: 11703 - DNA, 346 bp, Artificial
  Mutation in BnaC.FAD2.a introduced by TALE nuclease pair BnFAD2_T01
caggatccatgggtgcaggtggaagaatgcaagtgtctcccccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctacctcaccctctctcctatggcctctctactgggcctgccaagggtgcgtcctaaccggcgtctgggtcatagcccacgagtgcggccaccacgccttcagcgactac

SEQ ID NO: 11704 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccttcggctctctactgggcccgccaagggtgcgtcctaaccggcgtctgggtcatagcccacgagtgcggccaccacgccttcagcgactac

SEQ ID NO: 11705 - DNA, 349 bp, Artificial
  Mutation in BnaC.FAD2.a introduced by TALE nuclease pair BnFAD2_T01
caggatccatgggtgcaggtggaagaatgcaagtgtctcttccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgttggcctctctactgggcctgccaagggtgcgtcctaaccggcgtctgggtcatagcccacgagtgcggccaccgcgccatcagcgactac

SEQ ID NO: 11706 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgctctgtttcaaacgctcgatccctcgctctttctcctacctcatctgggacatcatcatagcctcctgcttctactacgtcgccaccacttacttccctctcctccctcaccctctctccgcctggcctctctactgggcctgccaagggtgcgtcctaaccggcgtctgggtcatagcccacgagtgcggccaccacgccttcagcgactac

SEQ ID NO: 11707 - DNA, 352 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgcccccacttacttccctctcctccctcaccctctcccctcctcccccggcctctctactgggcctgccaaggctgcgtcctaacgggcctctgggtcatagcccacgagtgcggccaccacgccttcagcgactac

SEQ ID NO: 11708 - DNA, 335 bp, Artificial
  Mutation in BnaC.FAD2.a introduced by TALE nuclease pair BnFAD2_T01
caggatccatgggtgcaggtgaaagaatgcaagtgtcacctccctccaagaagtctgaaaccgacaccatcaagcgcgtaccctgcgagacatcgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgtcctaaccggcgtctgggtcatagcccacgagtgcggccaccacgccttcagcgactac

SEQ ID NO: 11709 - DNA, 348 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccgtcagcgactac

SEQ ID NO: 11710 - DNA, 351 bp, Artificial
  Mutation in BnaC.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaaccggcgtctgggtcatagcccacgagtgcggccaccacgccttcagcgactac

SEQ ID NO: 11711 - DNA, 347 bp, Artificial
  Mutation in BnaC.FAD2.a introduced by TALE nuclease pair BnFAD2_T01
caggatccatgggtgcaggtggaagaatgcaagtctctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgccgcctggcctctctactgggcctgccaagggtgcgtcctaaccggcgtctgggtcatagcccacgagtgcggccaccacgccttcagcgactac

SEQ ID NO: 11712 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctaactctctactgggcctgccaagggtgcgtcctaaccggcgtctgggtcatagcccacgagtgcggccaccacgccttcagcgactac

SEQ ID NO: 11713 - DNA, 387 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgccatcggggctggcgatggccaccacctgctcctggcctctctactgggcctgtcaagggtgcgtcctaacgggcctctgggtcatcgcccacgaatgcggccaccacgccttcagcgactac

SEQ ID NO: 11714 - DNA, 346 bp, Artificial
  Mutation in BnaC.FAD2.a introduced by TALE nuclease pair BnFAD2_T01
caggatccatgggtgcaggtgcaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 11715 - DNA, 348 bp, Artificial
  Mutation in BnaC.FAD2.a introduced by TALE nuclease pair BnFAD2_T01
caggatccatgggtgcaggtggaagaatgcaagtctcccctccatccagctcccccgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttggcctctctactgggcctgccaagggtgcgtcctaaccggcgtctgggtcatagcccacgagtgcggccaccacgccttcagcgactac

SEQ ID NO: 11716 - DNA, 349 bp, Artificial
  Mutation in BnaC.FAD2.a introduced by TALE nuclease pair BnFAD2_T01
caggatccatgggtgcaggtggaagaatgcaagtctctcccccctccagctcccccgaaaccaaaaccctcaaccgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttaccttggcccctctacggggcttgccaaggctgagtcctaaggggcctctgggtcatagcccacaagtgcggcccccacgccttgagcgactac

SEQ ID NO: 11717 - DNA, 357 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccccccgcctggcctctctactgggcctgccaagggtgcgtcctaaccggcgtctgggtcatagcccacgagtgcggccaccacgccttcagcgactac

SEQ ID NO: 11718 - DNA, 344 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaagggtgcgtcctaaccggcgtctgggtcatagcccacgagtgcggccaccacgccttcagcgactac

SEQ ID NO: 11719 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacaagtgcggccaccacgccttcagcgactac

SEQ ID NO: 11720 - DNA, 335 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgtcctaaccggcgtctgggtcatagcccacgagtgcgaccaccacgccttcagcgactac

SEQ ID NO: 11721 - DNA, 356 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgctacttcgccgcctggcctctctactgggcctgccaagggtgctgccgaacgggcctcggggtcatctctcacgaatgctgcgaccacgccatcagcgactac

SEQ ID NO: 11722 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctacatggcctctctactgggcctgccaagggtgcgtcctaaccggcgtctgggtcatagcccacgagtgcggccaccacgccttcagcgactac

SEQ ID NO: 11723 - DNA, 355 bp, Artificial
  Mutation in BnaC.FAD2.a introduced by TALE nuclease pair BnFAD2_T01
caggatccatgggtgcaggtggaagaatgcaagtgtttcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcctggcctctctactgggcctgccaagggtgcgtcctaaccggcgtctgggtcagagcccacgagtgcggccaccacgccttcagcgactac

SEQ ID NO: 11724 - DNA, 348 bp, Artificial
  Mutation in BnaC.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatggcctctctactgggcctgccaagggtgcgtcctaaccggcgtcggggtcatagcccacgagtgcggccaccacgccttcatcgactac

SEQ ID NO: 11725 - DNA, 376 bp, Artificial
  Mutation in BnaC.FAD2.a introduced by TALE nuclease pair BnFAD2_T01
caggatccatgggtgcaggtggaagatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccaagggtgcgtcctaaccggcgtctgggtcatagcccacgagtgcggccaccacgccttcagcgactac

SEQ ID NO: 11726 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcagccaccacgccttcagcgactac

SEQ ID NO: 11727 - DNA, 276 bp, Artificial
  Mutation in BnaC.FAD2.a introduced by TALE nuclease pair BnFAD2_T01
caggatccatggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcgccctctctcctactccacgccttcagcgactac

SEQ ID NO: 11728 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttcgcctctctactgggcctgccaagggtgcgtcctaaccggcgtctgggtcatagcccacgagtgcggccaccacgccttcagcgactac

SEQ ID NO: 11729 - DNA, 318 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccaagggtgcgtcctaaccggcgtctgggtcatagcccacgagtgcggcctccgcgccttcagcgactac

SEQ ID NO: 11730 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 11731 - DNA, 318 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgcttcaaacgctcgatccctcgctctttctcctacctcatctgggacatcatcatagcctcctgcttctactacgtcgccaccacttggcaggcctctctactgggcctgccaagggtgcgtcctaaccggcgtctgggtcatagcccacgagtgcggccaccacgccttcagcgactac

SEQ ID NO: 11732 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtcggggtcatagcccacgagtgcggccaccacgccttcagcgactac

SEQ ID NO: 11733 - DNA, 345 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgccttcagcgactac

SEQ ID NO: 11734 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctaccaagggtgcgtcctaaccggcgtctgggtcatagcccacgagtgcggccaccacgccttcagcgactac

SEQ ID NO: 11735 - DNA, 339 bp, Artificial
  Mutation in BnaC.FAD2.a introduced by TALE nuclease pair BnFAD2_T01
caggatccatgggtgcaggtcgaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgggtcatagcccacgagtgcggccaccacgccttcagcgactac

SEQ ID NO: 11736 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 11737 - DNA, 348 bp, Artificial
  Mutation in BnaC.FAD2.a introduced by TALE nuclease pair BnFAD2_T01
caggatccatgggtgcaggtggaagaatgcaagtgtcccctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttggcctctctactgggcctgccaagggtgcgtcctaaccggcgtctgggtcatagcccacgagtgcggccaccacgccttcagcgactac

SEQ ID NO: 11738 - DNA, 343 bp, Artificial
  Mutation in BnaC.FAD2.a introduced by TALE nuclease pair BnFAD2_T01
caggatccatgggtgcaggtgaaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagctactac

SEQ ID NO: 11739 - DNA, 332 bp, Artificial
  Mutation in BnaC.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcagcctctctactgggcctgccaagggtgcgtcctaaccggcgtctgggtcatagcccacgagtgcggccaccacgccttcagcgactac

SEQ ID NO: 11740 - DNA, 389 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccacccaagtataaaccgtcgatgccctgctgaatattgaactgaaccaggcgactggcctctctactgggcctgccaagggtgcgtcctaaccggcgtctgggtcatagcccacgagtgcggccaccacgccttcagcgactac

SEQ ID NO: 11741 - DNA, 345 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctccctcaccctctctccttcggctctctactgggcctgccaagggtgcgtcctaaccggcgtctgggtcatagcccacgagtgcggccaccacgccttcagcgactac

SEQ ID NO: 11742 - DNA, 346 bp, Artificial
  Mutation in BnaC.FAD2.a introduced by TALE nuclease pair BnFAD2_T01
caggatccatgggtgcaggtggaagaatgcaagtgtctccttcctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgagtgcggccaccacgccttcagcgactac

SEQ ID NO: 11743 - DNA, 390 bp, Artificial
  Mutation in BnaC.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatcgcctcctgcttctactacgtcgccaccacttacttccctctcctccctcaccctctctcctacttgctggcgatggccaccacctgctggggggtcaagccgtgggcggcctctctactgggcctgccaagggtgcgtcctaacgggcctctgggtcagagcccacgagtgcggccaccacgccttcagcgactac

SEQ ID NO: 11744 - DNA, 346 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctggtacatcatcatagcctcctgcttctactacgtcgccaccacttacttccctctcctccctcaccctctctcccacttcctctctactgcgcctgccaagggtgcgtcctaaccggcgtctgggtcatagcccacgagtgcggccaccacgccttcagcgactac

SEQ ID NO: 11745 - DNA, 347 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccactagtgcggccaccacgccttcagcgactac

SEQ ID NO: 11746 - DNA, 348 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 11747 - DNA, 412 bp, Artificial
  Mutation in BnaC.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctccctgcccccgctggagacggtccagcggctgttgccggtgctgtgccaggcccacggcttgaccccggagctggcccctctactgggcctgccaaggctgcgtcctaacgggcctctgggtcatcgcccacgaatgcggccaccacgccgtcagcgactac

SEQ ID NO: 11748 - DNA, 357 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggtgcctggcctctctactgggcctgccaagggtgcgtcctaaccggcgtctgggtcatagcccacgagtgcggccaccacgccttcagcgactac

SEQ ID NO: 11749 - DNA, 339 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgggtcatagcccacgagtgcggcctccacgccttcagcgactac

SEQ ID NO: 11750 - DNA, 334 bp, Artificial
  Mutation in BnaC.FAD2.a introduced by TALE nuclease pair BnFAD2_T01
caggatccatgggtgcagggggaagaatgcaagtgtctcctccccccaagaagtctgaaaccgacaccatcaagcgcgtaccctgcgagacaccgcccttcactgtcggagaactcaagaaagcaatcccacctcactgtttcaaacgctcgatccctcgctctttctcctacctcatctgggacatcatcatagcctcctgcttctactacgtcgccaccgcttacttccctctcctccctcacccactctctactgggcctgccaagggtgcgtcctaaccggcgtctgggtcatagcccacgagtgcggccaccacgccttcagcgactac

SEQ ID NO: 11751 - DNA, 350 bp, Artificial
  Mutation in BnaC.FAD2.a introduced by TALE nuclease pair BnFAD2_T01
caggatccatgggtgcaggcggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 11752 - DNA, 347 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactccgtcgccaccacctacttccctctcctccctcaccctctctccgcctggcctctctactgggcctgccaaggctgcgtcctaacgggcgtctgggtcatagcccacgagtgcggccaccacgccttcagcgactac

SEQ ID NO: 11753 - DNA, 340 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctccctctacggggcctgccaaggctgcgtcctaacgggcctctgggtcagagcccacgagtgcggccaccacgccttcagcgactac

SEQ ID NO: 11754 - DNA, 348 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaacgggcctctgggtcatagtccacgagtgcggccaccacgccttcagcgactac

SEQ ID NO: 11755 - DNA, 343 bp, Artificial
  Mutation in BnaC.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctcgcctacccctctactgggcctgccaaggctgcgtcctaaccggcgtctgggtcatagcccacgagtgcggccaccacgccttcagcgactac

SEQ ID NO: 11756 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11757 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtaatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 11758 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11759 - DNA, 323 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccgctcgccgcagccgaacgaccgagaagaagtcagacatcaagtggtacggcaagtacctcaacaaccctttgggacgcaccgtgatgttaacggttcagttcactctcggctggcctttgtacttag

SEQ ID NO: 11760 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11761 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaacagtggctggacgacgccgtgggcctcgtcttccactccttcctcctcgtcccttacttctcctggagccatcgacgccaccattccaacactggctccctcgagagagacgacgtgtttgtccccaagaagaagtcagacatcaagtggtacggcaagtacctcaacaaccctttgggacgcaccgtgatgttaacggttcagttcactctcggctggcctttgtacttag

SEQ ID NO: 11762 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11763 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11764 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttcttcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 11765 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctagtcccttacttatcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 11766 - DNA, 336 bp, Artificial
  Mutation in BnaA.FAD2.a introduced by TALE nuclease pair BnFAD2_T02
cctctcctccctcaccctctctcctacttcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11767 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11768 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 11769 - DNA, 384 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctgcaatggcgatggcaagcaggcgctggagacggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11770 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11771 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtatcgacgccaccattccaacactggctccctcgagagagacgaagtgtttgtccccaagaagaagtcagacatccagtggtacggcaagtacctcaacaaccctttgggacgccccgggatgttaacggttcagttcactctcggctggcctttgtacttag

SEQ ID NO: 11772 - DNA, 349 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11773 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttttgtacttag

SEQ ID NO: 11774 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11775 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggatggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11776 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11777 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgattgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgtgacgcaccgtgatgttaacggttcagttcactctcggctggcctttgtacttag

SEQ ID NO: 11778 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11779 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 11780 - DNA, 415 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatagcgagtcagtgagcgaggaagcggaagagcgcccaatacgcaaaccgcctctcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11781 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttccctctcggctggcctttgtacttag

SEQ ID NO: 11782 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacgtag

SEQ ID NO: 11783 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11784 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11785 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaaagtcatcgacgccaccattccaacaccggatccctcgagagggatgaagtgttcgtccccaagaagaaatccgacatcaagtggttcggaaagtacctcaacaaccctttgggacgcaccgtgatgttaacggttcagttcactctcggctggcctttgtacttag

SEQ ID NO: 11786 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11787 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11788 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11789 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11790 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggtagccatcgacgccaccattccaacaccggatccctcgagagggatgaagtgttcgtccccaagaagaagtcagacatcaagtggtacggaaagtacctcaacgacccttggggacgcaccgtgatgttaacggttcagttcactctcggctggcctttgtacttag

SEQ ID NO: 11791 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11792 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtatcatcgacgccaccattccaacactggctccctcgagagagacgaactgtttgtccccaagaagaagtcagacatcaagtggtacggcaagtacctcaacatccctttgggacgcaccgtgatgttaacggttcagttcactctcggctggcctttgtacttag

SEQ ID NO: 11793 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaggtcagacatcaagtggtacggcaagtacctcaacaaccctttgggacgcaccgtgatgttaacggttcagttcactctcggctggcctttgtacttag

SEQ ID NO: 11794 - DNA, 343 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttgccatcgacgccaccattccaacactggctccctcgagagagacgaagtgtttgtccccaagaagaagtcatacatcaagtggtacggcaagtacctcaacaaccctttgggacgcaccgtgatgttaacggttcagttcactctcggctggcctttgtacttag

SEQ ID NO: 11795 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11796 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11797 - DNA, 419 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacattccgtggcgttatccagctaagcgcgaactgcaatttggagaatggcagcgcaatgacacatcgacgccaccattccaacactggctccctcgagagagactaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11798 - DNA, 391 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggccatagcccacgagtgcggccaccacgccttcagcgactaccagtggctggacgacaccgtcggcctcatcttccactccttcctcctcgtcccttacttctcctggaagtgtaggtcgttcgctccaagctgggctgtgtgcacgaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11799 - DNA, 379 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggtcgttcggctgcggcgagcggtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 11800 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11801 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11802 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgttgttaacggttcagttcactctcggctggcctttgtacttag

SEQ ID NO: 11803 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11804 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactcctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11805 - DNA, 415 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggatctccagcgcccgcttgccgccatcgtggcccacggcttgaccccccagcaggtggtggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtattag

SEQ ID NO: 11806 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgaatgcggccaccacgccttcagcgaccaccagtggctggacgacgccgtgggcctcgtcttccactccttcctcctcgtcccttacttctcctggaagttgtcatcgacgccaccattccaacactggctccctcgagagagacgaagtgtttgtccccaagaagaaatccgacatcaagtggtacggaaagtacctcaacaaccctttgggacgcaccgtgatgttaacggttcagttcactctcggctggcctttgtacttag

SEQ ID NO: 11807 - DNA, 357 bp, Artificial
  Mutation in BnaA.FAD2.a introduced by TALE nuclease pair BnFAD2_T02
actctcctccctcaccctctctcctacttcgcctggcctctctactgggcctgccaagggtgcgtcttaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11808 - DNA, 363 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11809 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11810 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11811 - DNA, 350 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 11812 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11813 - DNA, 351 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11814 - DNA, 341 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11815 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgcgcggctggcctttgcacttag

SEQ ID NO: 11816 - DNA, 389 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatggtggccatcgccagcaatggcggtgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11817 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11818 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggccatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 11819 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11820 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11821 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11822 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11823 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11824 - DNA, 294 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctccttgtcaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11825 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctaggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11826 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11827 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11828 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11829 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11830 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtccggcaagtacctcaacgcccctttgggacgcaccgggttgttaacggttcagttcactcgcggcgggccgttgtccttag

SEQ ID NO: 11831 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 11832 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11833 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccatggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 11834 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 11835 - DNA, 355 bp, Artificial
  Mutation in BnaA.FAD2.a introduced by TALE nuclease pair BnFAD2_T02
cctctcctccctcaccctctcccttacatcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11836 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11837 - DNA, 318 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11838 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11839 - DNA, 319 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11840 - DNA, 358 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11841 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 11842 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11843 - DNA, 395 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagttgaccccccagcaggtggtggccatcgccagccaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11844 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11845 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11846 - DNA, 358 bp, Artificial
  Mutation in BnaA.FAD2.a introduced by TALE nuclease pair BnFAD2_T02
cctctcctcctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11847 - DNA, 356 bp, Artificial
  Mutation in BnaA.FAD2.a introduced by TALE nuclease pair BnFAD2_T02
ccttcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11848 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11849 - DNA, 405 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcctcttccactccttcctcctcgtcccttacttctcctggaatgacggatggccttctgcttagtttgatgcctggcagtttatggcgggcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11850 - DNA, 341 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11851 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccatcaccctcatcttccactccttcctcctcgtaccttacttctcctggaagtagccatcgacgccaccattccaacaccagatccctcgagagggatgaagtgttcgtccccaagaagaaatccaacatcaagtggtacgaaaagtaccgcaacaacccgttgggacgcacagtgatgttaacggttcagttcactctcggatggcctgcgtacttag

SEQ ID NO: 11852 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11853 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11854 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11855 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggccatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 11856 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacaccggatccctcgagagggatgaagtgttcgtccccaagaagaaatccgccatcaagtggtacggaaagtacctcaacaacccgctagggcgcacggtgatgctaaccgtccagttcacgctcggctggcctttgtacttag

SEQ ID NO: 11857 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacaccggatccctcgagagggatgaagtgttcgtccccaagaagaaatccgacatcgagtggtacggaaagtacctcaacaacccgctaggacgcacggtgatgctaaccgtccagttcacgctcggctggcctttgtacgtag

SEQ ID NO: 11858 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11859 - DNA, 350 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgatcgacgccaccattccaacaccggatccctcgagagggatgaagtgttcgtccccaagaagaagtcagacatcatgtggtacggcaagtacctcaacaaccctttgggacgcaccgtgatgttaacggttcagttcactctcggctggcctttgtacttag

SEQ ID NO: 11860 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtcttggtcatcgcccacgaatgcggccaccacgccttcagcgactaccagtggctggacgaccccgtcgccctcatcttccactccttcctcctcgtcccttacttctcctggaatcatcgactccgccattccaacactggctccctcgagagagacgaagtgtttgtccccaagaagaagtccgccatcaagtcgtacggcacgtacctcaacaaccctttgggccgcactgtgacgttaacggttcagttcactctcggccggcatttgtacttag

SEQ ID NO: 11861 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11862 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcaattcactctcggctgccctttgtacttaa

SEQ ID NO: 11863 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11864 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11865 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 11866 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11867 - DNA, 344 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11868 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 11869 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 11870 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagggccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11871 - DNA, 387 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaaggcgatggccaccacctgctccggggtcacagtcatcgacgccaccattccaacactggctcccccgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11872 - DNA, 415 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggacgtatagcgagtcagtgagcgaggaagcggaagagcgcccaatacgcaaaccgcctctcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11873 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11874 - DNA, 353 bp, Artificial
  Mutation in BnaA.FAD2.a introduced by TALE nuclease pair BnFAD2_T02
cctctcctcctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 11875 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacgtag

SEQ ID NO: 11876 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11877 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 11878 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11879 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacggcgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11880 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11881 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11882 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11883 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11884 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagcagtcagacatcaagtggtacggcaagtacctcaacaaccctctgggacgcaccgtgatgttaacggttcagttcactctcggctggcctttgtacttag

SEQ ID NO: 11885 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 11886 - DNA, 306 bp, Artificial
  Mutation in BnaA.FAD2.a introduced by TALE nuclease pair BnFAD2_T02
cctctcctccctcaccctctcccttacctcggctggcctctctactgggcctgccagggctgcgtcctaaccggcgtctgggtcatagcccacgagtgcggccaccacgccttcagcgactaccagtggctggacgacaccgtcatcgacgccaccattccaacactggctccctcgagagagacgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 11887 - DNA, 341 bp, Artificial
  Mutation in BnaA.FAD2.a introduced by TALE nuclease pair BnFAD2_T02
cctctcctccctcaccctctctcctacttcgcctggcctctctactgggcctgccagggctgcggcctaaccggcgtctgggtcatagcccacgagtgcggccaccacgccttcagcgactaccagtggcttgacgacaccgtcggtctcatcttccactccttcccccgcgtcccttatgtctcctggaaattccaacactgcctccctcgggagagacgaagtgtttgtccccaagaagaagtcagacatcaactagtccgacaagtacctctccaaccctttgggacgcaccgtgatgttaacggttcagttcacttgcggctggccttagtacttat

SEQ ID NO: 11888 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11889 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11890 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgccccgtgatgttaacggttcagttcactctcggctggcctttgtacttag

SEQ ID NO: 11891 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcgaccaccacgccttcagcgaccaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11892 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcttcccttacttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11893 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcgccgtgatgttaacggttccgttcactctcggctggcctttgtacttag

SEQ ID NO: 11894 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11895 - DNA, 360 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11896 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11897 - DNA, 337 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcttccacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11898 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11899 - DNA, 415 bp, Artificial
  Mutation in BnaA.FAD2.a introduced by TALE nuclease pair BnFAD2_T02
cctctcctccctcaccctctcccttacctcgcctggcccctctaccgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagtccgcctttgagtgagctgataccgctcgccgcagccgaacgaccgagcgcagcgagagtcatcgacgccaccattccgacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11900 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11901 - DNA, 336 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11902 - DNA, 389 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtctggcgccgtcgggcttcctggagccgcccagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctaggctggcctttgtacttag

SEQ ID NO: 11903 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11904 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11905 - DNA, 356 bp, Artificial
  Mutation in BnaA.FAD2.a introduced by TALE nuclease pair BnFAD2_T02
cctctcctccctcaccctctctcctacttctcctggcctctctactggacctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacctgctaggtcgctcggtgatgctaaccctccagttcacgcccggctggcctttggacttag

SEQ ID NO: 11906 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 11907 - DNA, 358 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11908 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11909 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacatcgacgccaccattccaacactggctccctcgagagagacgaagtgtttgcccccaagaagaagtcagacatcaagtggtacggcaagtacctcaacaaccctttgggacgcaccgtgatgttaacggttcagttcactctcggctggcctttgtacttag

SEQ ID NO: 11910 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11911 - DNA, 350 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11912 - DNA, 336 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 11913 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11914 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11915 - DNA, 332 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11916 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11917 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11918 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 11919 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11920 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11921 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11922 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11923 - DNA, 294 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctccttgtcaagtgtttgtccccaggaagaagtcagacatcaagtggtacggcaagtacctcaacaaccctttgggacgcaccgtgatgttaacggttcagttcactctcggctggcctttgtacttag

SEQ ID NO: 11924 - DNA, 342 bp, Artificial
  Mutation in BnaA.FAD2.a introduced by TALE nuclease pair BnFAD2_T02
cctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttcctcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgcccggctggcctttgtacttag

SEQ ID NO: 11925 - DNA, 365 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaactacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11926 - DNA, 339 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtgccttacgacgccaccattccaacacttgctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11927 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 11928 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11929 - DNA, 322 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11930 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11931 - DNA, 349 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11932 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctgcacgacaccgtcggcctcatcttccactccttcctcctcgtcccttacttctcctggaaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 11933 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaagcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11934 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcggcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11935 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11936 - DNA, 364 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11937 - DNA, 354 bp, Artificial
  Mutation in BnaA.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11938 - DNA, 291 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggcttgacgacaccgtcggaagactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11939 - DNA, 422 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacggcttgaccccggagcaggtggtggccatcgccagccacgatggcggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11940 - DNA, 335 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactcaccattccaacactggctccctcgagagagacgaagtgtttgtccccaagaagaagtcagacatcaagttgtacggcaactacctcaacatccctttgggacgccccgtgatgttaacggttcagttcactctcggctggcctttgtacttag

SEQ ID NO: 11941 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagagagacgaagtgtttgtccccaagaagaagtcagacatcaagtggtacgacaagtacctcaacaaccctttgggacgcaccgtgatgttaacggttcagttcactctcggctggcctttgtacttag

SEQ ID NO: 11942 - DNA, 336 bp, Artificial
  Mutation in BnaA.FAD2.a introduced by TALE nuclease pair BnFAD2_T02
cctctcctccctcaccctctctcctacctcgcctggcctctctactgggcctgccaaggctgcgtcctaacgggcgtctgggtcatagcccacgagtgcggccaccacgccttaagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacgccccagttggacgcacggtgatgctaacggttcagttccctctcggctggcctttgtacttag

SEQ ID NO: 11943 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11944 - DNA, 342 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccctgtcatcgacgccaccattccaacactggctccctcgagagagacgaagtgtttgtccccaagaagaagtcagccatcaagtggtacggcaagtacctcaccaaccctttgggacgcaccgtgatgttaacggttaagttcactctcggctggcctttgtacttag

SEQ ID NO: 11945 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 11946 - DNA, 332 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctggcacagcaccggcaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11947 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtggtcctcatcttccactccttcctcctcgtcccttacttctcctggaagtcatcgacgccaccattccaacactggctccctcgagagagccgaagtgtttgtccccaagaagaagtcacacatcaagtggtacggcaagtacctcaacaaccctttgggacgcactgtgatgttaacggttcagttcacgctcggctggcctttgtacttag

SEQ ID NO: 11948 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11949 - DNA, 328 bp, Artificial
  Mutation in BnaA.FAD2.a introduced by TALE nuclease pair BnFAD2_T02
cctctcctccctaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11950 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagggagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11951 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 11952 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacaggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11953 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttttacttag

SEQ ID NO: 11954 - DNA, 409 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagcaacagccgctggaccgtctccagcgcctgcttgccgccatcgtggctggcgagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11955 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11956 - DNA, 350 bp, Artificial
  Mutation in BnaA.FAD2.a introduced by TALE nuclease pair BnFAD2_T02
ctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctccttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11957 - DNA, 415 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagactgggcctttcgttttatctgggtccagcggctgttgccggtgctgtgccaggcccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11958 - DNA, 356 bp, Artificial
  Mutation in BnaA.FAD2.a introduced by TALE nuclease pair BnFAD2_T02
cctctcctccctcaccctctctcctacttcgcctggcctctctactggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaaatcagacatcgagtggtacggcaagtacctcaacatccctttgggacgcaccgtgatgttaacggttcagttcgctctcggctggcctttgtacttag

SEQ ID NO: 11959 - DNA, 391 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtaggtcgttcgctccaagctgggctgtgtgcacgaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11960 - DNA, 315 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcatcgacgccaccattccaacactggctccctcgagagagacgaagtgtttgtccccaagaagaagtcagacatcaagtggtacggcaagtacctcaacacccctttgggacgtaccgtgatgttaacggttcagttcactctcggctggcctttgtacttag

SEQ ID NO: 11961 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11962 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcgccgtgatgttaacggttcagttcactctcggctggcctttgtacttag

SEQ ID NO: 11963 - DNA, 447 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagcaatgacattcttgcaggtatcttcgagccagccacgatcgacattgatctggctatcttgctgacaaaagcaagagaacatagcgttgcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11964 - DNA, 357 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacaacggcgagctttgatcaacgaccaccattccaacactggctccctcgagatagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11965 - DNA, 378 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgcgtcatagcccacgagtgccgtcaccacgccttcagcgactaccagtggctggacgacaccgtcggcctcatcttccactccttcctcctcgtcccttacttctcctggatatggcggcaagcaggcgatggagtcatcgacgccaccattccaacactggctccctcgagagagacgaagtgtttgtccccaagaagaagtcagacatcaagtggtacggcaagtaccgcaacaacccgctaggacgcacggtgatgctaaccgtccagttcacgctcggctggcatttgtacttag

SEQ ID NO: 11966 - DNA, 312 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttaacgacaccgtcggtctcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactcccggatgccctttgtacttag

SEQ ID NO: 11967 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactacaagtggctggacgacaccgtcggcctcatcttccactccttcctcctcgtcccttacttatccatgacgccaccattccaacaccggatccctcgatagggacgaagtgttcgtccccaagaagaaatccgacatcaagtggtacggcaagtacctcaacaacccgctaggacgcacggtgatgctaaccgtccagttcacgctcggctggcctttgtacttag

SEQ ID NO: 11968 - DNA, 291 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11969 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11970 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaaacatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 11971 - DNA, 383 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagtttgaccccggagcaggtggtggccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11972 - DNA, 350 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggtctcatcttccactcctttctcctcgtcccttactcctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 11973 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11974 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11975 - DNA, 441 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagctcggtttgatcgacagtggcgcagcaccacgaggcactggtcggccacgggtttacacacgcgcacatcgttgcgttaagccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11976 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 11977 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11978 - DNA, 357 bp, Artificial
  Mutation in BnaA.FAD2.a introduced by TALE nuclease pair BnFAD2_T02
cctctcctccctcaccctctctcctacttcgcctggcctctctactgggcctgtcagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11979 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11980 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11981 - DNA, 356 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11982 - DNA, 357 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11983 - DNA, 358 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11984 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgaccgccagtggctggacgacgccgtgggcctcgtcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11985 - DNA, 321 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11986 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttgg

SEQ ID NO: 11987 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgactaccagtggctggacgacaccgtcggcctcatcttccactccttcctcctcgtcccttacttctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11988 - DNA, 336 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggcttgacgacaccgtgggcctcgtcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11989 - DNA, 441 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagtccacgagtgcggccaccacgccttcagcgactaccagtggctggacgacaccgtcggcctcctcttccactccttcctcctcgtcccttacttctcctggaagtgtgccaggcccacggcttgaccccccagcaggtggtggccatcgccggccagcaacgtcggttcgagatggcgctcgatgacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11990 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctacgtcctaaccggcgtctgggtcatagcccacgagtgcggccaccaccccttcagcgactaccagtggctggacgacagcgtcggcctcatcttccactccttcctcctcgtcccttacttctcctggaagtagccatcgacgccaccattccaacactggctccctcgagagagacgaagtgtttgtccccaagaagaagtcagacatcgagtggtacggcaagtacctcaacaaccctttgggacgcaccggaatgttaacggttcagttcactctcggctggcattagtacttag

SEQ ID NO: 11991 - DNA, 417 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtggagcggatttgtcctactcaggagagcgttcaccgacaaacaacagataaaacgaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11992 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaacccgctaggacgcacggtgaggctaaccgtccagttcacgctcggctggcctttgtacttag

SEQ ID NO: 11993 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 11994 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 11995 - DNA, 417 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggatttgtcctactcaggagagcgttcaccgacaaacaacagataaaacgaaaggccgtcagtcatcgacgccaccattccaacactggctccctcgagagagacgaagtgtttgtccccaagaagaagtcagacatcaagtggtacggcaagtacctcaacaacccgctaggacgcacggggatgctaaccgtccagttcacgctcggctggcctttgtacttag

SEQ ID NO: 11996 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcattgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11997 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 11998 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactcattcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 11999 - DNA, 388 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccttctgcttagtttgatgcctggcagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12000 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcggctaccagtggcttgacgacaccgtcggtctcatcttccactccttcctcctcgtcccttacttctcctggaagttggttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12001 - DNA, 357 bp, Artificial
  Mutation in BnaA.FAD2.a introduced by TALE nuclease pair BnFAD2_T02
cctctcctccctaaccctctcccttacctcgccttgctcctctactgggcctgccaaggctgcgtcctaacggccctctgggtcatcgcccacgaatgcagcaacccctccttcagcgactaccagtggctggacgacaccgtcggcctcatcttccactccttcctcctctgcccttgcttctcctggaaggtcatcgacgccaccattccaacactgtctccctcgagagagacgaagtgtttgtccccaagaagaagtcagacatcaagtcgtacgccatctacctcaacacccccttcggacgcaccatgttgttaacggttcaattctctctcggctggcccttgtacttcg

SEQ ID NO: 12002 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12003 - DNA, 454 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacatactggaaagcgggcagtgagcgcaacgcaattaatacgcgtaccgctagccaggaagagtttgtagaaacgcaaaaaggccctccgtcagcagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12004 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12005 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgatgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12006 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12007 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcgccgcgatgttaacggctcaggtcactctcggcggtccttagtacttag

SEQ ID NO: 12008 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactcgcggctggcctgtgtacttag

SEQ ID NO: 12009 - DNA, 349 bp, Artificial
  Mutation in BnaA.FAD2.a introduced by TALE nuclease pair BnFAD2_T02
cctctcctccctcaccctctcccttacctcgcctggcccctctactgggcctgccaaggctgcatcctaacgggcctctgggtcatcgcccacgaatgcggccaccacgccttcagcgactaccagtggctggacgacaccgtcggcctcatcttccactccttcctcctcgtcccttacttctcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12010 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaacgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacgtag

SEQ ID NO: 12011 - DNA, 330 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12012 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtcgtacggcaagtaccccaacacccttgtgggccgcgccgtgttgttaacggttcagttcactcccggctgccctttgtccttag

SEQ ID NO: 12013 - DNA, 363 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatacagtcatcgacgccaccattccaacactggctccctcgagagagacgaagtgtttgtccccaagaataagtcagacatcaagtggtacggcaagtacctcaacaaccctttgggacgcaccgtgatgttaacggttcagttcactctcggctggcctttgtacttag

SEQ ID NO: 12014 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12015 - DNA, 355 bp, Artificial
  Mutation in BnaA.FAD2.a introduced by TALE nuclease pair BnFAD2_T02
cctctcctccctcaccctctctcctacttcgcctgccctctctactgggcctgccagggctgcgtcctaaccggcgtctgggtcatagcccacgagtgcggccaccacgccttcagcgactaccagtggcttgacgacaccgtcggtctcctcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttggcacgcaccgtgatgttaacggttcagttcactctcggctggcctttgtacttag

SEQ ID NO: 12016 - DNA, 346 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccaccattccaacactggctccctcgagagagacgaagtgtttgtccccaagaagaagtcagacatcaagtggtacggcaagtacctcaacaaccctttgggacgcaccgtgatgttaacggttcagttcactctcggccggcctttgtacttag

SEQ ID NO: 12017 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttggaacgcaccgtgatgttaacggttcagttcactctcggctggcctttgtacttag

SEQ ID NO: 12018 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 12019 - DNA, 353 bp, Artificial
  Mutation in BnaA.FAD2.a introduced by TALE nuclease pair BnFAD2_T02
cctctcctccctcaccctctcccttacatcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12020 - DNA, 358 bp, Artificial
  Mutation in BnaA.FAD2.a introduced by TALE nuclease pair BnFAD2_T02
cctctcctccctcaccctctcccttacctcgcctggcccctctaccgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12021 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcgacgccaccattccaatactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12022 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgatcatcgacgccaccattccaacaccggatccctcgagagggatgaagtgttcgtccccaagaagaaatcagacatcaagtggtacggcaagtacctcaacaaccctttgggacgcaccgtgatgttaacggttcagttcactctcggctggcctttgtacttag

SEQ ID NO: 12023 - DNA, 469 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgcgccgttaccaccgctgcgttcggtcaaggttctggaccagttgcgtgagcgcatacgctactggcatacttgacagcgacggtccctaacgctgccgggtgttggcttagtcatcgacgccaccattccaacactggctccctcgagagagacgaagtgtttgtccccaagaagaagtcagacatcaagtggtacggcaagtacctcaacaaccctgtgggacgcaccgtgatgttaacggttacgttcactctcggctggctttggtccttag

SEQ ID NO: 12024 - DNA, 356 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 12025 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12026 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12027 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttaacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12028 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12029 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12030 - DNA, 432 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacaccgtcggcctcatcttccactccttcctcctcgtcccttacttctcctggaagtggaccgtctccagcgcctgcttgccaccgccattgctggcgatggccaccacctgctggggggtcaagttgagcgggtggtacggcaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12031 - DNA, 411 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacgcgtaccgctagccaggaagagtttgtagaaacgcaaaaaggccatccccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12032 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 12033 - DNA, 385 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcgtcttccactccttcctcctcgtcccaatacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12034 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12035 - DNA, 352 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12036 - DNA, 335 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactcaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12037 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcatcgacgccaccattccaacactggctccctcgagagagacgaagtgtttgtccccaagaagaagtcagacatcaagtggttcgccatgtacctcaacagccctttgggacacaccgtaatgttaacggttcagttcactctcggctggcctttgtacttag

SEQ ID NO: 12038 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12039 - DNA, 385 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcctcttccactccttcctcaagccgtgggcctggcacagcaccggcaacagccgctggaccgtctccagctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12040 - DNA, 330 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12041 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12042 - DNA, 422 bp, Artificial
  Mutation in BnaA.FAD2.a introduced by TALE nuclease pair BnFAD2_T02
cctctcctccctcaccctctcccttacctcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacggcttgaccccggagcaggtggtggccatcgccagccacgatggcggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactgag

SEQ ID NO: 12043 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12044 - DNA, 356 bp, Artificial
  Mutation in BnaA.FAD2.a introduced by TALE nuclease pair BnFAD2_T02
cctctcctccctcaccctctccctaacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12045 - DNA, 366 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagctactaccagtggcttgacgacaccgtcggtctcatcttccactccttcctcctcgtcccttacttctcctggaagtacaatacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 12046 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 12047 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 12048 - DNA, 317 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacctgctccggggtcaagccgtgggcctggcacagcaccggcaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12049 - DNA, 354 bp, Artificial
  Mutation in BnaA.FAD2.a introduced by TALE nuclease pair BnFAD2_T02
cctctcctccctcaccctctctcctacttcgcctggcctctctactgggcccgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12050 - DNA, 315 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccaatggcggtggcaagcaggcgctggagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12051 - DNA, 335 bp, Artificial
  Mutation in BnaA.FAD2.a introduced by TALE nuclease pair BnFAD2_T02
cctctcctccctcaccctctccctacctcgcctggcccctctactgggcctgccaaggctgcgtcctaacgggcctctgggtcatcgcccacgaatgcggccaccacgccttcagcgacccccagtggctggacgacgccgtgggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12052 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12053 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12054 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12055 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 12056 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccactaatgcggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12057 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacaccggatccctcgagagagacgaagtgtttgtccccaagaagaagtcagacatcaagtggtacggcaagtacctcaacaacccgctaggacgcacggtgatgctaaccgtccagttcacgctcgtctggcctttgtacttag

SEQ ID NO: 12058 - DNA, 356 bp, Artificial
  Mutation in BnaA.FAD2.a introduced by TALE nuclease pair BnFAD2_T02
cctctcctccctcaccctctcccttacctcgcctggaacctctactgggcctgccaaggctgcgtcctaacgggcctctgggtcatcgcccacgaatgcggccaccacgccttcagcgaccaccagtggctggacgacgccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccttgggcgcgctccgtgatgttaacggttcagttcactctcggctggcctttgtacttag

SEQ ID NO: 12059 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12060 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12061 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacaggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12062 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12063 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12064 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 12065 - DNA, 350 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggcttgacgacaccgtcggcctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12066 - DNA, 405 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaatgttgccaccgccattgctggcgatggccaccacctgctggggggtcaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12067 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtggtgttagcggttcagttcactctcgactggccttgtacttag

SEQ ID NO: 12068 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12069 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12070 - DNA, 451 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctgtgagcatttttgacaagaaatatttgctagctgatagtgaccttaggcgacttttgaatacgctacttgcattacagcttacgaaccgaacaggcttagtcatcgacgccaccattccaacactggctccctcgagagagacgaagtgtttgtccccaagaagaagtcagacatcaagtggtacggcaagtacctcaacaaccctttgggacgcgccgtgatggtaacggttcagttcactctcggctggcctttgtacttag

SEQ ID NO: 12071 - DNA, 348 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12072 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12073 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcgccgtgatggtaacggtgcaggtctctctcggctggccttggtacttag

SEQ ID NO: 12074 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12075 - DNA, 427 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaagtacaaggcggtaatacggttatccacagaatcaggggataacgatatcgatgctgtccatgtgctgtacagtcatcgacgccaccattccaacactggctccctcgagagagacgaagtgtttgtccccaagaagaagtcagacatcaagtggtacggcaagtacctcaacaaccctatgggacgcaccgggatgttaacggttcagtgcactctcggctggcctttgtacggag

SEQ ID NO: 12076 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggtcgcaccgtgatgttaacggttcatttcactctcggctggcctttgtacttag

SEQ ID NO: 12077 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12078 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccatttgggacgcaccgtgatgttaacggttcagttcactctcggctggcctttgtacttag

SEQ ID NO: 12079 - DNA, 419 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacattccgtggcgttatccagctaagcgcgaactgcaatttggagaatggcagcgcaatgacacatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12080 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12081 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccgacgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 12082 - DNA, 350 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcatcgacgccaccattccaacactggctccctcgagagagacgaagtgtttgtccccaagaagaagtcagacatcaagtggtacggcaagtacctcaacaaccccttgggacgcaccgtgatgttaacggttcagttcactctcggctggcctttgtacttag

SEQ ID NO: 12083 - DNA, 347 bp, Artificial
  Mutation in BnaA.FAD2.a introduced by TALE nuclease pair BnFAD2_T02
cctctcctccctcaccctctcccctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctccacgacgccaccattccaacactggctccctcgagagagacgaagtgtttgtccccaagaagaagtcagacatcaagtggtacggcaagtacctcaacaaccctttgggacggaccgttatgttaacgggtcagttcactctcggctggcctttttacttag

SEQ ID NO: 12084 - DNA, 467 bp, Artificial
  Mutation in BnaA.FAD2.a introduced by TALE nuclease pair BnFAD2_T02
cctctcctccctcaccctctctcctacttcgcctggtctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacactccttcctcctcgtcccttacttctcttcgtaacgcgcttgctgcttggatgcccgaggcatagactgtaccccaaccagaccaggaacaagcacatcaaccccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgcccggctggcctttgtacttag

SEQ ID NO: 12085 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 12086 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12087 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttcctcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 12088 - DNA, 359 bp, Artificial
  Mutation in BnaA.FAD2.a introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcaggtcactctcggctggcctgtgtacttag

SEQ ID NO: 12089 - DNA, 354 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtattag

SEQ ID NO: 12090 - DNA, 388 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaggcctttttacggttcctggccttttgcgtacagtcatcgacgccaccattccaacactggctccctcgagagagacgaagtgtttgtccccaagaagaagtcagacatcaagtggtacggcaagtacctcaacaaccctttaggacgcaccgtgatgttaacggttcagttcactctcggctggcctttgtacttag

SEQ ID NO: 12091 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcacggtgatgttaacggttcagttcactctcggctggcctttgtacttag

SEQ ID NO: 12092 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcccatcgacgccaccattccaacaccggatccctcgagagggatgaagtgtttgtccccaagaagaagtcagacatcaagtggtacggcaagtacctcaacaaccctttggaacgcaccgtgatgttaacggttcagttcactctcggctggcctttgtacttag

SEQ ID NO: 12093 - DNA, 350 bp, Artificial
  Mutation in BnaA.FAD2.a introduced by TALE nuclease pair BnFAD2_T02
ccttcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 12094 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttggttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12095 - DNA, 388 bp, Artificial
  Mutation in BnaA.FAD2.a introduced by TALE nuclease pair BnFAD2_T02
cctctcctccctcaccctctcccttacctcgcctggaacctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccttctgcttagtttgatgcctggcagtacagtcatcgacgccaccattccaacactggctccctcgagagagacgaagtgtttgtccccaagaagaagtcagacatcaagtggtacggcaaggacctcaacaacccttggggacgcgccgtgatgttaacggttcaggtcgctctcggctggcctttgtacttag

SEQ ID NO: 12096 - DNA, 349 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12097 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 12098 - DNA, 354 bp, Artificial
  Mutation in BnaA.FAD2.a introduced by TALE nuclease pair BnFAD2_T02
cctctcctccctcaccctctcccttacctcgcctggaccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggaaagtacctcaacagcccgctaggaggctcagtgatgctaaccgtccagttcccgctgggcgggcctttgtactta

SEQ ID NO: 12099 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgggggacgcaccgtgatgttaacggttcagttcactctcggctggcctgtgtacttag

SEQ ID NO: 12100 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12101 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacacgggctccctcgagagagacgaagtgtttgtccccaagaagaagtcagacatcaagtggtacggcaagtacctcagcaaccctttgggacgcaccgtgatgttaacggttcagttcactctcggctggccttagtacttag

SEQ ID NO: 12102 - DNA, 355 bp, Artificial
  Mutation in BnaA.FAD2.a introduced by TALE nuclease pair BnFAD2_T02
cctctcctccctcaccctctcccttacctcgcctggcctctctactgggcctgccaaggctgcgtcctaacgtgcctctgggtcatcgcccacgaatgcggccaccacgccttcagcgaccaccagtggctggacgacgccgtgggcctcgtcttccactccttcctccacgtcccttacttctcctggagtcatcgacgccaccattccaacactggctccctcgagagagacgaagtgtgtgtccccaagaagaagtcagacatcaactggtacgacaagtacctctacaaccctttggaacgaaccgggatgttaacggttcaggtcactcttggctggcctttatacttag

SEQ ID NO: 12103 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12104 - DNA, 378 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcatcatcttccactccttcctcctcgtcccttacttctcctggatatggcggcaagcaggcgatggagtcatcgacgccaccattccaacactggctccctcgagagagacgaagtgtttgtccccaagaagaagtcagacatcaagtggtacggaaagtacctcaacaacccgcgaggacgcacggtgatgctaaccggccaggtctcgctcgtctggcctttgtacttag

SEQ ID NO: 12105 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttatacttag

SEQ ID NO: 12106 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12107 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgagtgcggccaccacgccttcagcgactaccagtggctggacgacaccgtcggcctcatcttccactccttcctcctcgtcccttacttctcctggacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 12108 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgaccaccagtggctggacgacgccgtgggcctcatcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggccttgtacttag

SEQ ID NO: 12109 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 12110 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 12111 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12112 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtaatcgacgccaccattccaacactggctccctcgagagagacgaagtgtttgtccccaagaagaagtcagacatcaagtggtacggcaagtacctcaacaaccctttgggacgccccgtgatgttaacggttcagttcactctcggctggcctttgtaacttag

SEQ ID NO: 12113 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcctggaaaagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcactctcggctggcctttgtacttag

SEQ ID NO: 12114 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggcgggcctttgtacttag

SEQ ID NO: 12115 - DNA, 362 bp, Artificial
  Mutation in BnaA.FAD2.a introduced by TALE nuclease pair BnFAD2_T02
cctctcctccctcaccctctcccttacctcgcctggaccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctgtgggacgcaccgtgattttaacggttcagttctctcccggttggcctttttacttag

SEQ ID NO: 12116 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggagagagacgaagtgtttgtccccaagaagaagtcagacatcaagtggtacggcaagtacctcaacacccctttgggacgcaccgtgatgttaccggttcagttccctctcggctggcctttgtacttag

SEQ ID NO: 12117 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgagtacttag

SEQ ID NO: 12118 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcatggatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12119 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12120 - DNA, 363 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12121 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12122 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctctagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12123 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12124 - DNA, 384 bp, Artificial
  Mutation in BnaA.FAD2.a introduced by TALE nuclease pair BnFAD2_T02
cctctcctccctcaccctctcccttacctcgcctggcccctctactgggcctgcaaaggctgcgtcctaacgggcctctgggtcatcgcccacgagtgcggccaccacgccttcagcgaccaccagtggctggacgacgccgtgggcctcgtcttccactccttcctcctcgtcccttacttctcctggaagccacgatggcggcaagcaggcgctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 12125 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactag

SEQ ID NO: 12126 - DNA, 357 bp, Artificial
  Mutation in BnaA.FAD2.a introduced by TALE nuclease pair BnFAD2_T02
cctctcctccctcaccctctctcctacttcgtctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacacccctttgggacgcaccgtgatgttaacggttcagttccctctcggctggcctttgtacttag

SEQ ID NO: 12127 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgtaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12128 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcatttgtacttag

SEQ ID NO: 12129 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttgtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 12130 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12131 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12132 - DNA, 359 bp, Artificial
  Mutation in BnaA.FAD2.a introduced by TALE nuclease pair BnFAD2_T02
cctctcctccctcaccctctcccttacctcgcctggcccctctactgagcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 12133 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactcctcctcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctgtgtacttag

SEQ ID NO: 12134 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcacacatcaagtggtacggcaagtacctcagcaaccgtttgggacgcaccgtggtgttaacggttcaggtcactctcggctggcctttgtacttag

SEQ ID NO: 12135 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 12136 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccacaagaagaagtcagacatcaagtggtacggcaagtacctcaacaaccctttgggacgcaccgtgatgttaacggttcagttcactctcggctggcctttgtacttag

SEQ ID NO: 12137 - DNA, 417 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtggagcggatttgtcctactcaggagagcgttcaccgacaaacaacagataaaacgaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12138 - DNA, 335 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggcaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12139 - DNA, 408 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaccgtcgctgtcaagtatcaggacatgatcgcagcgttgccagaggcgacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12140 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgtggccaccacgccttcagcgactaccagtggctggacgacaccgtcggcctcatcttccactccttcctcctcgtcccttacttctcctggagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 12141 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12142 - DNA, 388 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaggcctttttacggttcctggccttttgcgtacagtcatcgacgccaccattccaacactggctccctcgagagagacgaagtgttggtccccaagaagaagtcagacatcaagtggtacggcaagtacctcaacaaccgtgtgggacgcaccgggagggtaacggttcaggtgactctcggctggcttttgtactcag

SEQ ID NO: 12143 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12144 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12145 - DNA, 411 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacgcgtaccgctagccaggaagagtttgtagaaacgcaaaaaggccatccccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12146 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacaccggatccctcgagagggatgaagtgttcgtccccaagaagaagtcagacatcaagtggtacggaaagtacctcaacaacccgctaggacgcacggtgatgctaaccgtccagttcacgctcggctggcctttgtacttag

SEQ ID NO: 12147 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggaagactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12148 - DNA, 423 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttactttccagcgcctgcttgccgccatcgtggctggcgatggccaccacctgctggggggtcaagccgtgggcctggcacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12149 - DNA, 437 bp, Artificial
  Mutation in BnaA.FAD2.a introduced by TALE nuclease pair BnFAD2_T02
cctctcctccctcaccctctcccttacctcgcctggcccctctactgggcgtgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagtaccgtctccagcggctgttgccggtgctgtgccaggcccacggcttgaccccggagcaggtggtggccatcgccatacagtcatcgacgccaccattccaacactggctccctcgagagagacgaggtgtttgtccccaagaagaagtcagacatcaagtggtacggcaagtacctcaacacccctttgggacgcaccgggattttaacggttcagttcactctcggctggcctttgtacttag

SEQ ID NO: 12150 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 12151 - DNA, 362 bp, Artificial
  Mutation in BnaA.FAD2.a introduced by TALE nuclease pair BnFAD2_T02
cctctcctccctcaccctctctcctacttcgcctggcctctctactgggcctgtcaagggtgcgtcctaacgggcctctgggtcatcgcccacgaatgcggccaccacgccttcagcgaccaccagtggctggacgacgccgtgggcctcgtcttccactccttcctcctcgtcccctacttctcctggaagttacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12152 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 12153 - DNA, 417 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactcctttctcctcgtcccttacttctcctggaagtggagcggatttgtcctactcaggagagcgttcaccgacaaacaacagataaaacgaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12154 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgctccggtatgttaacgggtcagttctctctcggctggccttcatacttag

SEQ ID NO: 12155 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcgtctggcctttgtacttag

SEQ ID NO: 12156 - DNA, 356 bp, Artificial
  Mutation in BnaA.FAD2.a introduced by TALE nuclease pair BnFAD2_T02
cctctcctccctaaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12157 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggagtcatcgacgccaccattccaacactggctccctcgagagagacgaagtgtttgtccccaagaagaagtcagacatcgagtggtacggcgagtacctcaacaaccctttgggacgcaccgtgatgttaacggttcagttcactctcggctggccttagtacttag

SEQ ID NO: 12158 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12159 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactag

SEQ ID NO: 12160 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtccattacttctcctggaagtcatcgacgccaccattccaacactggctccctcgagagagacgaagtgtttgtccccaagaagaagtcagacatcaagtggtacggcaagtacctcaacaaccctgtgggacgcaccgggaggttaacggttcaggtcactcccggctggcctttgtacttag

SEQ ID NO: 12161 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggatgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaagccagacatcaagtggtacggcaagcaccccagcaaccgttcgggacggaccgtgagtttaacggctcaggtcagtctcggctgccctcagtgcttag

SEQ ID NO: 12162 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccctttgcctggcacagcaccggcaacagccgctggaccgtctccagctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12163 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12164 - DNA, 356 bp, Artificial
  Mutation in BnaA.FAD2.a introduced by TALE nuclease pair BnFAD2_T02
cctctcctccatcaccctctctcctacttcgcctggcctctctactgggcctgccagggctgcgtcctaaccggcgtctgagtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 12165 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12166 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12167 - DNA, 405 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaatgttgccaccgccattgctggcgatggccaccacctgctggggggtcaagccatcgacgccaccattccaacaccggattcctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 12168 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtaccgcaacaaccctttggggcgcaccgttatgttaacgggtcatttcactctcgtctggcctttatacttag

SEQ ID NO: 12169 - DNA, 360 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 12170 - DNA, 348 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttagtcatcgacgccaccattccaacactggctccctcgagagagacgaagtgtttgtccccaagaagaagtcagacatcaagtggtacggcaagtacctcaacaaccctttgggacgcaccgtgattttaacggttcagttccctctcggctggcctttgtacttag

SEQ ID NO: 12171 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12172 - DNA, 340 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12173 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12174 - DNA, 387 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtccctttgcctggcacagcaccggcaacagccgctggaccgtctccagctgtcatcgacgcaaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12175 - DNA, 359 bp, Artificial
  Mutation in BnaA.FAD2.a introduced by TALE nuclease pair BnFAD2_T02
cctctcctccctcaccctctcccttacctcgcctggcccctctcctgggcctgccaaggatgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactcgctccctcgagagagacgaagtgtttgtccccaagaagaagtcagacatcaagtggtacggcaagtacctcaacaaccctttgggacgcgccgtgatgttaacggtgcagttcactctcggctggcctttgtacttag

SEQ ID NO: 12176 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12177 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaagttatcagccatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 12178 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttcaactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12179 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgtgcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctctagagagacgaagtgtttgtccccaagaagaaggcagccatcaagtggcacggcaagaacctctaaaaacttctggatcgccccgtgatgttaacggttcagttcattctcggctggcatgagtacgtag

SEQ ID NO: 12180 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctagtcatcgacgccaccattccaacaccggatccctcgagagggatgaagtgttcgtccccaagaagaaatccgacatcaagtggtacggaaagtacctcaacaacccgttaggacgcacggtgatgctaacggtccagttcacgctcggctggcctttgtacttag

SEQ ID NO: 12181 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcatttgtacttag

SEQ ID NO: 12182 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcacggggatgctaaccgtccaggtcacgctcggctggcctttgtacttaa

SEQ ID NO: 12183 - DNA, 354 bp, Artificial
  Mutation in BnaA.FAD2.a introduced by TALE nuclease pair BnFAD2_T02
cctctcctccctcaccctctcccttacctcgcctggcccatctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaatatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12184 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctctggggcgcaccgtgatgttaacggttcagttcactctcggctggcctttatacttag

SEQ ID NO: 12185 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12186 - DNA, 408 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggccgacgccgtgggcctcgtcttccactccttcctcctcgtcccttacttctcctggaaccgtcgctgtcaagtatcaggacatgatcgcagcgttgccagaggcgacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12187 - DNA, 355 bp, Artificial
  Mutation in BnaA.FAD2.a introduced by TALE nuclease pair BnFAD2_T02
cctctcctccctcaccctctcccttacctcgcctggcccatctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12188 - DNA, 365 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacgccgtgggcctcgtcttccactccttcctcctcgtcccttacttcctcctcgtcccttacttctcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 12189 - DNA, 357 bp, Artificial
  Mutation in BnaA.FAD2.a introduced by TALE nuclease pair BnFAD2_T02
cctctcctccctcaccctctctcctacttcgcctgacctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccgccattccaacactggctccctcgagagagacgaagtgtttgtccccaagaagaagtcagacatcaagtggtacggcaagtacctcaacaaccctttgggacgcaccgtgatgttaaggtttcagttcagtcgcggctggcctgtgtacttag

SEQ ID NO: 12190 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12191 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccatcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12192 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctccatcatcgacgccaccattccaacactggctccctcgagagggatgaagtgtttgtccccaagaagaagtcagacatcaagtggtacggcaagtacctcaacaaccctttgggacgcaccgtgatgttaacggttcagttcactctcggctgccctttgtacttag

SEQ ID NO: 12193 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12194 - DNA, 339 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccaccatttcaacactggcttcctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12195 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacgacaagtacctcaacaaccctttgggtcgcaccgggatgttaacgtttcatttcactctcggctggcctgtgtacttag

SEQ ID NO: 12196 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggacgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12197 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 12198 - DNA, 388 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtcaataatggtggcaagcaggcgctggatccaagaagaaatccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtgcttag

SEQ ID NO: 12199 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggatgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcacacatcaagtggtacggcaagtacctcaacaaccgtctgggacggaccgtgaggttaagggttcggttcagtctcggctggcttcagtgcttag

SEQ ID NO: 12200 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgcctgggtcatagcccacgagtgcggccaccacgccttcagcgactaccagtggctggacgacaccgtcggcctcatcttccactccttcctcctcgtcccttacttctcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12201 - DNA, 350 bp, Artificial
  Mutation in BnaA.FAD2.a introduced by TALE nuclease pair BnFAD2_T02
cctctcctccctcaccctctctcctacttcgcctggaccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttactcctcctcatcgacgccaccattccaacactggctccctcgagggagacgaagtgtttgtccccaagaagaagtcagacatcaagtggtacggcaagtacctcaacaaccctttgggacgcaccgggatgttaacggtgcaggtcacgctcggctggcctttgtacttag

SEQ ID NO: 12202 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacattccaacactggctccctcgagagagacgaagtgtttgtccccaagaagaagtcagacatcaagtggtacggcaagtacctcaacaaccctgtgggacgcaccgggatgttaacggtgcagttcactctcggctggcctttgtacttag

SEQ ID NO: 12203 - DNA, 411 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtaccttacttctcctggaagtacgcgtaccgctagccaggaagagtttgtagaaacgcaaaaaggccatccccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12204 - DNA, 309 bp, Artificial
  Mutation in BnaA.FAD2.a introduced by TALE nuclease pair BnFAD2_T02
cctctcctccccaccctctctcctacttcgcctggcctctctactgggcctgccagggctgcgtcctaaccggcgtctgggtcatagcccacgagtgcggccaccacgccttcagcgactaccagtggctggacgacaccgtcggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12205 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12206 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggccttggtacttag

SEQ ID NO: 12207 - DNA, 394 bp, Artificial
  Mutation in BnaA.FAD2.a introduced by TALE nuclease pair BnFAD2_T02
cctctcctccctcacgctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccgctcgccatgcatgcactgcctccactgcggtagtcatcgacgccaccattccaacactggctccctcgagagagacgaagtgtttgtccccaagaagaaatccgacatcaagtggtacggaaagtaccgcaacaacccgccaggacgcacggttatgctaaccgtccaggtcacgctcgtctggcctttgtgcttag

SEQ ID NO: 12208 - DNA, 417 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtggagcggatttgtcctactcaggagagcgttcaccgacaaacaacagataaaacgaaaagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 12209 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12210 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccagggctacgtcctaaccggcgtctgggtcatagcccacgagtgcggccaccacgccttcagcgactaccagtggctggacgacaccgtcggcctcatcttccactccttcctcctcgtcccttgcttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12211 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaacagtcatcgacgccaccattccaacactggctccctcgagagagacgaagtgtttgtccccaagaagaagtcagacatcaagtggtacggcaagtaccacaacaaccctttgggacgcaccgtgatgttaacggttcagttcactctcggctggcattagtacttag

SEQ ID NO: 12212 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 12213 - DNA, 318 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12214 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12215 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 12216 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12217 - DNA, 294 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggctggacgacaccgtcggcctcatcttccactccttcctccttgtcaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12218 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagtgcacgctcggcgggcctttgtacttag

SEQ ID NO: 12219 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgatcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 12220 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctgaggtacgcaccgtgatggtaacggttcagttctctctcggctggcctgtgtacttag

SEQ ID NO: 12221 - DNA, 356 bp, Artificial
  Mutation in BnaA.FAD2.a introduced by TALE nuclease pair BnFAD2_T02
cctctcctccctcaccctctcccttacctcgcctggcccctctactgcgcctgccaaggctgcgtcctaacgggcctctgggtcatcgcccacgaatgcggccaccacgccttcagcgaccaccagtggctggacgccgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcgccgttatgttaacggttcatttctctctcggctggcctttttacttag

SEQ ID NO: 12222 - DNA, 306 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcatcgacgccaccattccaacactggctccctcgagagagacgaagtgtttgtccccaagaagaagtcagacatcaagtggtacggcaagtacctcaacaaccctttgtgtcgcaccgtgatgttaacggttcagttcactctcggctgccctttgtacttag

SEQ ID NO: 12223 - DNA, 351 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcgcccaccacgccttcagcgactaccagtggctggacgacaccgtcggcctcatcttccactccttcctcctcgtccctgacttctcctggaacgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 12224 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctctgggacgcaccgtgatgttaacggttcagttcactctcggctgccctttgtacttag

SEQ ID NO: 12225 - DNA, 389 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggatctcaagaagatcctttgatcttttctacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12226 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12227 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacaccgtcggcctcatcttccactccttcctcctcgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 12228 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 12229 - DNA, 353 bp, Artificial
  Mutation in BnaA.FAD2.a introduced by TALE nuclease pair BnFAD2_T02
cctctcctccctcaccctctctcctacttcgcctggcatctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacaacccttggggacgcagcgggatgttaacggttcagttcggtctcggctggccttagtacttag

SEQ ID NO: 12230 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgttcgtccccaagaagaaatccgacatcaagtggtacggaaagtacctcaacaacccgctaggacggacggtgatgctaaccgtccagttcactctcggctggcctttgtgcttag

SEQ ID NO: 12231 - DNA, 355 bp, Artificial
  Mutation in BnaA.FAD2.a introduced by TALE nuclease pair BnFAD2_T02
cctctcctccctcaccctctctcctacttcgcctggccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcgccgggatgttaacggtgcagttcactctcggctggccttggtacttag

SEQ ID NO: 12232 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaagtcatcgacgccaccattccaacactgtctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12233 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 12234 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12235 - DNA, 355 bp, Artificial
  Mutation in BnaA.FAD2.a introduced by TALE nuclease pair BnFAD2_T02
cctctcctccctcaccctctctcctacttcgcctggcccctttactgggcctgccaaggctgcgtccaaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12236 - DNA, 356 bp, Artificial
  Mutation in BnaA.FAD2.a introduced by TALE nuclease pair BnFAD2_T02
cctctcctccctcaccctctcccttacctcgcctgccccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtaccgcaacaaccctttgggacgcaccgtgatgttaacggttcagttcactctcggctggcctttgtacttcg

SEQ ID NO: 12237 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgttatgttaacgggtcagttctctctcggctggcctttgtacttag

SEQ ID NO: 12238 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12239 - DNA, 441 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagctcggtttgatcgacagtggcgcagcaccacgaggcactggtcggccacgggtttacacacgcgcacatcgttgcgttaagccagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12240 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12241 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12242 - DNA, 383 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtctccagcgcctgcttgccaccgccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgagtacttag

SEQ ID NO: 12243 - DNA, 336 bp, Artificial
  Mutation in BnaA.FAD2.a introduced by TALE nuclease pair BnFAD2_T02
cctctgctccctcaccctctctcctacttcgcctggcacctctactgggcctgccaaggctgcgtcctaacgggcctctgggtcatcgcccacgaatgtggccaccacgccttcagcgaccaccagtggctggacgacgccgtgggcctcgtcttccactccttcctcctcgtcatcgacgccaccattccaacactggctccctcgagagagacgaagtgtttgtccccaagaagaagtcagacatcaagtggtacggcaaggacctcaacaaccctttgggacgcgccgggatgttaacggtgcatttcactcgcggctggcatgagtacttag

SEQ ID NO: 12244 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctcgctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 12245 - DNA, 329 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactaccagtcatcgacgccaccattccaacaccggctccctcgagagagacgaagtgtttgtccccaagaagaagtcagacatcaagtggtacggaaagtacctcaacaaccctttgggacgcaccgtgatgttaacggttcagttcactctcggctggcctgtgtacttag

SEQ ID NO: 12246 - DNA, 357 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 12247 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtcgctggacgacaccgtcggcctcatcttccactccttcctcctcgtcccttacttctcctggaagttgtcatcgacgccaccattccaacactggctccctcgagagagacgaagtgtctgtccccacgcaccagccacacatcaagtggtacggcaagtacctcaacatgcctcctggacgcggcgtgatgttaagggcacagttcaggctcgcatggcctctgtgcttac

SEQ ID NO: 12248 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12249 - DNA, 357 bp, Artificial
  Mutation in BnaA.FAD2.a introduced by TALE nuclease pair BnFAD2_T02
cctctcctccctcaccctctcccttacctcgcctcgcccctccactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12250 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12251 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 12252 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaaccctctaggacgcacggtgatgctaaccgtccagttcactctcggctggcctttgtacttag

SEQ ID NO: 12253 - DNA, 411 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtcggcctcatcttccactccttcctcctcgtcccttacttctcctggagtcttcatgaaggtgtacggctacaggggcaagcacctgggcggctccaggaagcagtcatcgacgccaccattccaacactggctccctcgagagagacgaagtgttggtccccaagaagaagtcagacatcaagtggtacggcaagtacctcaacaaccctttgggacgcaccgtgatgttaacggttcagttcactcgcggctggcctttgtacttag

SEQ ID NO: 12254 - DNA, 336 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12255 - DNA, 357 bp, Artificial
  Mutation in BnaA.FAD2.a introduced by TALE nuclease pair BnFAD2_T02
cctctcctccctcaccctctctcctacttcgcctggcctctctactgagcctgccagggctgcgtcctaaccggcgtctgggtcatagcccacgagtgccgccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacaacaagtggtacggcaagtacctcaacaaccctctgggacgcaccgtgatgttaacggtgcagttcactctcggctggcctttgtacttag

SEQ ID NO: 12256 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 12257 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctccacgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12258 - DNA, 357 bp, Artificial
  Mutation in BnaA.FAD2.a introduced by TALE nuclease pair BnFAD2_T02
ctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12259 - DNA, 355 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcatttgtacttag

SEQ ID NO: 12260 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12261 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12262 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12263 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12264 - DNA, 389 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtacagcaacgtcggttcgagatggcgctcgaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12265 - DNA, 359 bp, Artificial
  Mutation in BnaA.FAD2.a introduced by TALE nuclease pair BnFAD2_T02
cctctcctccctcaccatctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12266 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12267 - DNA, 467 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggcaacgtcggttcgagatggcgctcgatgacgccaactacctctgatagttatttatgagatgggtttttatgattagagtcccgcaattatacatttaatacgcgataggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12268 - DNA, 467 bp, Artificial
  Mutation in BnaA.FAD2.a introduced by TALE nuclease pair BnFAD2_T02
cctctcctccctcaccctctctcctacttcgcctggcctctctactgagcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggcaacgtcggttcgagatggcgctcgatgacgccaactacctctgatagttatttatgagatgggtttttatgattagagtcccgcaattatacatttagtacgcgataggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggactttgtacttag

SEQ ID NO: 12269 - DNA, 354 bp, Artificial
  Mutation in BnaA.FAD2.a introduced by TALE nuclease pair BnFAD2_T02
cctctcctccctcaccctctctactacttcgcctggcctctctaatgggcctgccagggctgcgtcctaaccggcgtctgggtcatagcccacgagtgcgaccaccacgccttcagcgactaccagtggctggacgacaccgtcggcctcatcttccactccttcctcctcgtcccttacttctcctggaagatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12270 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12271 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12272 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgggatgttaacggttcagttcactcgcggctggccttagcacttag

SEQ ID NO: 12273 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 12274 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 12275 - DNA, 337 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcttccacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 12276 - DNA, 353 bp, Artificial
  Mutation in BnaA.FAD2.a introduced by TALE nuclease pair BnFAD2_T02
cctctcctccctcaccctctcccttacctcgcctggaccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggcctttgtacttag

SEQ ID NO: 12277 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtcatcgacgccaccattccaacactggctccctcgagagagacgaagtgtttgtccccaagaagaagtcagacatcaagtggtacggcaagtacctcaacaacccgttgggacgcgccgtgatgttaacggttcagttcactctcggctggcctttgtacttag

SEQ ID NO: 12278 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 12279 - DNA, 348 bp, Artificial
  Mutation in BnaA.FAD2.a introduced by TALE nuclease pair BnFAD2_T02
cctctcctccctcaccctctctcctacttcgcctggcctctctactgcgcctgccagggctgcgtcctaaccggcgtctgggtcatagcccacgagtgcggccaccacgccttcagcgactaccagtggctggacgacaccgtcggcctcatcttccactccttcctcctcgtcccttacttcttcatcgacgccaccattccaacactggctccctcgagagagacgaagtgtttgtccccaagaagaagtcagacatcaagtggtacggcaagtacctcaacaaccctttgggacgcaccgtgatgttaacggttcagttctctctcggctggcctttgtacttag

SEQ ID NO: 12280 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagaaagtcatcgacgccaccattccaacactggctccctcgagagagacgaagtgtttgtccccaagaagaagtcagacatcaagtggtacggcaagtacctcaacaaccctttgggacgaaccgttatgttaacggttcagttcactctcggctggcctttgtacttag

SEQ ID NO: 12281 - DNA, 356 bp, Artificial
  Mutation in BnaA.FAD2.a introduced by TALE nuclease pair BnFAD2_T02
cctctcctccctcaccctctatcctacttcgcctcgcctctctactgcgcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacacccctttgggacgcgccggaatgttaacggtgcagttcactcccggctggcctttgtacttag

SEQ ID NO: 12282 - DNA, 359 bp, Artificial
  Mutation in BnaA.FAD2.a introduced by TALE nuclease pair BnFAD2_T02
cctctcctccctcaccctctctcctacttcgcctggcctctctactgggcctgctaaggctgcgtcctaacgtgcctctgggtcatcgcccacgaatgcggccaccacgccttcagcgaccaccagtggctggacgacgccgtgggcctcgtcttccactccttcctcctcgtcccttacttctcctggaagcagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12283 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggccttagtacttag

SEQ ID NO: 12284 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttcatcgacgccaccattccaacactggctccctcgagagagacgaagtgtttgtccccaagaagaaatccgacatcaagtggtacggaaagtgcctcaacaacccgctagaacgcacggtgatgctaaccgtccaggtcacgctcggctggcctttgtacttag

SEQ ID NO: 12285 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 12286 - DNA, 345 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12287 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 12288 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcgtcttccactccttcctcctcgtcccttacttctcctggaagtagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 12289 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12290 - DNA, 392 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacaacactggctccctcgagagagacgaagtgtttgtcatcgacgccaccattccaacactggctccctcgagagagacgaagtgtttgtccccaagagaagtcagacatcaagtggtacggcaagtacctcaacaaccctttgggacgcaccgtgatgttaacggttcagttcactctcggctggcctttgtacttag

SEQ ID NO: 12291 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12292 - DNA, 355 bp, Artificial
  Mutation in BnaA.FAD2.a introduced by TALE nuclease pair BnFAD2_T02
cctctcctccctcaccctctcccttacctcgcctggaccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12293 - DNA, 336 bp, Artificial
  Mutation in BnaA.FAD2.a introduced by TALE nuclease pair BnFAD2_T02
cctctcctccctcaccctctctcctacttcgcctggactctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctgtgggacgcaccgtgatgttaacggttcaggtctctcccggctggccgttgtacttag

SEQ ID NO: 12294 - DNA, 362 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgccaacgaatgcggccaccacgccttcagcgaccaccagtggctggacgacgccgtgggcctcgtcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12295 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12296 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacaccgtcggcctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12297 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaaggtcatctacgccaccattccaacactggctccctcgagagagacgaagtgtttgtccccaagaagaagtcagacatcaagtgttacggcaagtacctcaacaaccctgtgggacgcaccgtgatgttaacggttcagttcactctcggctggcctttgtacttag

SEQ ID NO: 12298 - DNA, 354 bp, Artificial
  Mutation in BnaA.FAD2.a introduced by TALE nuclease pair BnFAD2_T02
cctctcctccctcaccctctcccttacctcgcctggcccctccactgggcctgccaaggctgcgtcctaacgggcctctgggtcatcgcccacgaatgcggccaccacgccttcatcgaccaccagtggctggacgacgccgtgggcctcgtcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcgggtggcctttgtacctag

SEQ ID NO: 12299 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttcttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12300 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcctctgggtcatcgcccacgagtgcggccaccacgccttcagcgaccaccagtggctggacgacgccgtgggcctcgtcttccactccttcctcctcgtcccttacttctcctggaagagccatcgacgccaccatcccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12301 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccttttggacgcacggtgatgctaaccgtccagttcacgctcggctggcctttgtacttag

SEQ ID NO: 12302 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagaaagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 12303 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagccatcgacgccaccattccaacaccggatccctcgagagggatgaagtgttcgtccccaagaagaaatccgacatcaagtggtacggcaagtacctcaacaaccctttgggacgcaccgtgttggtaacggttcagttcactcccggctggcctttgtacttag

SEQ ID NO: 12304 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttatacttag

SEQ ID NO: 12305 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12306 - DNA, 417 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgactaccagtggcttgacgacaccgtcggtctcatcttccactccttcctcctcgtcccttacgtctccagtggctgttgccggtgctgtgccaggcccacggcttgaccccggagcaggtggtggccatcgccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12307 - DNA, 306 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12308 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtgccggaacaaccctatggggcgcaccgtgaggttcacgtgtcagttcactctcggctggcctttgtacttag

SEQ ID NO: 12309 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgccctaaccggcgtctgggtcatagcccacgagtgcggccaccacgccttcagcgactaccagtggctggacgacaccgtcggcctcatcgacgccaccattccaacactggctccctcgagagagacgaagtgtttgtccccaagaagaagtcagacatcaagtagtacggcaagtacctcaacaaccctgtgggacgcaccatgatgttaacggttcaattcactctcggctggccttagtacttag

SEQ ID NO: 12310 - DNA, 317 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagacgaagtgtttgtccccaagaagaagtcagacatcaagttgtacggcaagtacctcaacaacccttggggacgcaccgtgatgttaacggttcagttcactctcggctggcctatgaattag

SEQ ID NO: 12311 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgttatgttaacggttcagttcactctcggcaggcctttatacttag

SEQ ID NO: 12312 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttagtacttag

SEQ ID NO: 12313 - DNA, 312 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatcgcccacgaatgcggccaccacgccttcagcgaccaccagtggctggacgacaccgtcggcctcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtactgag

SEQ ID NO: 12314 - DNA, 355 bp, Artificial
  Mutation in BnaA.FAD2.a introduced by TALE nuclease pair BnFAD2_T02
cctctcctccctcaccctctctcctacttcgcctggcctctctactcggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggagccatcgacgccaccattccaacaccggatccctcgagagagacgaagtgtttgtccccaagaagaagtcagacatcaagtggtacggcaagtacctcaacaaccctttgggacgcaccgtggtgttaacggttcagttcactctcggctggcctttgtacttag

SEQ ID NO: 12315 - DNA, 354 bp, Artificial
  Mutation in BnaA.FAD2.a introduced by TALE nuclease pair BnFAD2_T02
cctctcctccctcaccctctctcctacttcgcctcgcctctctactgggcctgccagggctgcgtcctaaccggcgtctgggtcatagccaacgagtgcggccaccacgccttcagcgactaccagtggctggacgacaccgtcggcctcatcttccactccttcctcctcgtcccttacttctcctcagtcatcgacgccaccattccaacactggctccctcgagagagacgaagtgtttgtccccaagaagaagtcagacatcaagtggtacggcaagtaccgcaacagccctttgggacgcagcgtgatgttatcggttcagttcactctcggctggcctttatacttag

SEQ ID NO: 12316 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12317 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggtctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttctctctcggctggcctttgtacttag

SEQ ID NO: 12318 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12319 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggatgcgtcctaaccggcgtctgggtcatagcccacgagtgcggccaccacgccttcagcgactaccagtggctggacgacaccgtcggcctcatcttccactccttcctcctcgtcccttactaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 12320 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtgcctcaacagccctttgggacgcaccgtgatgctaacggttcagtgcactctcgggtggcctttgtacttag

SEQ ID NO: 12321 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcatctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12322 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaagcgtttgggacgcaccgtgatgttaacggttcagttcactctcggctggcctttgtacttag

SEQ ID NO: 12323 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcagggtgatgctaaccttccagttcacgctcggctggcctttgtacttag

SEQ ID NO: 12324 - DNA, 358 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaacgggcctctgggtcatcgcccacgaatgcggccaccacgccttcagcgactaccagtggcttgacgacaccgtcggtctcatcttccactccttcctcctcgtcccttacttctcctggaagtatcatcgacgccaccattccaacactggctccctcgagagagacgaagtgtttgtccccaagaagaagtcagacatcaagtggtacggcaagtaccgcaacaaccctttgggacgcaccgtgatgttaacggttcagttcactctcggctggcctttgtacttag

SEQ ID NO: 12325 - DNA, 372 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactcaagtcagaggtggcgaaacccgacagtcatcgacgccaccattccaacactggctccctcgagagagacgaagtgtttgtccccaagaagaagtcagacatcaagtggtacggcaagtacctcaacaaccctttgggacgcaccgggatgttaacggttcaggtcactcgcggctggcctttgtacttag

SEQ ID NO: 12326 - DNA, 344 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttcctaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12327 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttcttcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12328 - DNA, 341 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12329 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 12330 - DNA, 393 bp, Artificial
  Mutation in BnaA.FAD2.a introduced by TALE nuclease pair BnFAD2_T02
cctctcctccctcaccctctctcctacttctcctttactctctactgcgcctgccagggctgcgtcctaaccggcgtctgggtcatagcccacgagtgcggccaccacgccttcagcgactaccagtggctggacgacaccgtccgcctcctcttccactccttcctcctcgtcccttacttctcctagaagtacaacactggctccctcgagagagacgaagtgtttgtcatcgacgccaccattccaacaccggatccctcgagagggatgaagtgttcgtccccaagaagaaatccgacatcaagtggtacggcaagtacctcaacaacccggtgggacgcggcgtgaggttatcggggccattctctcttggctgcccttgttacgtag

SEQ ID NO: 12331 - DNA, 452 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcatcttccactccttcctcctcgtcccttacttctcctggaagtactgccaccacctgctccggggtcaagccgtgggcctggcacagttggaaacttcggcttcccctggagagagcgagattctccgcgctgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12332 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12333 - DNA, 358 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12334 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgtgacgcaccgtgatgttaacggttcagttcactctcggctggcctttgtacttag

SEQ ID NO: 12335 - DNA, 332 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaactggctccctcgagagagacgaagtgtttgtccccaagaagaagtcagacatcaagtggtacggcaagtgcctcaacaaccctttgggacgcaccgtgatgttaacggttcagttcactctcggctggcctttgtacttag

SEQ ID NO: 12336 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgaatgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 12337 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcatcccttacttctcctggaagggtcatcgacgccaccattccaacactggctccctcgagagagacgaagtgtttgtccccaagaagaagtcagacatcaagtggtacggcaagtacctcaacaaccctttggagcgcaccgtgatgttaacggttcagttcactctcgtctggcctttgtacttag

SEQ ID NO: 12338 - DNA, 355 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12339 - DNA, 306 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12340 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacagtcatcgacgccaccattccaacactggctccctcgagagagacgaagtgtttgtccccaagaagaaatccgacatcaagtggtacggaaagtacctcaacaaccctttgggacgcaccgtgatgttaacggttcagttcactctcggctggcctttgtacttag

SEQ ID NO: 12341 - DNA, 357 bp, Artificial
  Mutation in BnaA.FAD2.a introduced by TALE nuclease pair BnFAD2_T02
cctctcctccctcaccttctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12342 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12343 - DNA, 357 bp, Artificial
  Mutation in BnaA.FAD2.a introduced by TALE nuclease pair BnFAD2_T02
cctctcctccctcaccctctcccttacctcgcctggactcactactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12344 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12345 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgcccccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12346 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12347 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 12348 - DNA, 291 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgccaccattccaacactggctccctcgagagagacgaagtgtttgtccccaagaagaagtcagacatcaagtggcacggcaagtacctcaacaaccctttgggacgcaccgtgatgttaacggttcagttcactctcggctggcctttgtacttag

SEQ ID NO: 12349 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 12350 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacatcgacgccaccattccaacactggctccctcgagagagacgaagggtttgtccccaagaaaaagtcagacatcaagtggtacggcaagtacctcaacaaccctttgggacgcaccgggatgttaccggttcagttcactcgcggctggccttagtacttag

SEQ ID NO: 12351 - DNA, 331 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12352 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 12353 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttaattctcctggacatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12354 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 12355 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcgtctgggtcatagcccacgagtgcggccaccacgccttcagcgactaccagtggctggacgacaccgtcggcctcatcttccactccttcctcctcgtcccttacttctcctggaagtcatctacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12356 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgcaaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttatacttag

SEQ ID NO: 12357 - DNA, 310 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12358 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcagcaagccttcgggacggagggtgatgcttagcgtccgggtcaggctcggctggcctctgtgcttag

SEQ ID NO: 12359 - DNA, 441 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagctcggtttgatcgacagtggcgcagcaccacgaggcactggtcggccacgggtttacacacgcgcacatcgttgcgttaagccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12360 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12361 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttttacttag

SEQ ID NO: 12362 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacaccggatccctcgagagggatgaagtgttcgtccccaagaagaaatccgacatcaagtggtacggaaagtacctcaacaacccgctaggacgcacggttatgctaaccgtccagttcactctcggctggcctttgtacttag

SEQ ID NO: 12363 - DNA, 349 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcccaaccggcgtctgggtcatagcccacgagtgcggccaccacgccttcagcgactaccagtggctggacgacaccgtcggcctcatcttccactccttcctcctcgtcccttaatcgtgtcatcgacgccaccattccaacactggctccctcgagagagacggagtgtttgtccccaagaagaagtcagacatcaagtggtacggcaagtacctcaacaaccctttgggacgcaccgtgatgttaacgtttcagttcactctcggctggcctttgtacttag

SEQ ID NO: 12364 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggctttgtacttag

SEQ ID NO: 12365 - DNA, 332 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttatcctggaagtggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 12366 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 12367 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12368 - DNA, 306 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcatcgacgccaccattccaacactggctccctcgagagagacgaagtgtttgtccccaagaagaagtcagacatcaagtggtacggcaagtacctcaacaaccctttggggcgcaccgtgatgttaacggttcaggtcactctcggctggcctttgtacttag

SEQ ID NO: 12369 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12370 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 12371 - DNA, 344 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12372 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 12373 - DNA, 390 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaggcgctaaatgaaaccttaacgctatggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 12374 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12375 - DNA, 351 bp, Artificial
  Mutation in BnaA.FAD2.a introduced by TALE nuclease pair BnFAD2_T02
cctctcctccctcaccctctctcctccttcgcctcgcctctctacttggcctgccagtgctgcgtcctaaccggcgtctgcgacatagcccacgagtgcggccaccacgccttcagcgactaccagtggctggacgacaccgtcggcctcatcttccactccttcctcctcgtcccttacttctccatcatcgacgccaccattccaacactggctccctcgagagagacgaagtgtttgtccccaagaagaactcagacatccgtcggtagggcaagtaccgcaacagacatatgggacgcaccgtcatgttaacggttcagttcagtcccggctggcctttgtacttag

SEQ ID NO: 12376 - DNA, 363 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaacccttcgggacgcaccgtgatgttaacggttcagttcactctcggctggcctttgtacttag

SEQ ID NO: 12377 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaacggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgttgggacgcaccgtgatgttaacggttcatttcactcgcggctggcctttgtacttag

SEQ ID NO: 12378 - DNA, 357 bp, Artificial
  Mutation in BnaA.FAD2.a introduced by TALE nuclease pair BnFAD2_T02
cctctcctccctcaccctctatcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12379 - DNA, 359 bp, Artificial
  Mutation in BnaA.FAD2.a introduced by TALE nuclease pair BnFAD2_T02
cctctcctccctcaccctctctcctacttcgcctggcctctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 12380 - DNA, 357 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacactggctccctcgagagagacgaagtgtttgtccccaagaagaagtcagacatcaagtggtacggcaagtacctcaacaaccctttgggacgctccgtgatgttaacggttcagttcactctcggctggcctttggacttag

SEQ ID NO: 12381 - DNA, 408 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttgagcggggcacccgtcagtgcattgcgccatgcatgcactgcctccaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12382 - DNA, 361 bp, Artificial
  Mutation in BnaA.FAD2.a introduced by TALE nuclease pair BnFAD2_T02
cctctcctccctcaccctctctcctacttcacctggcctctctactgggcctgccaagggtgcgtcctaaccggcgtctggtcatagcccacgagtgcggccaccacgccttcagcgactaccagtggctggacgacaccgtcggcctcatcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12383 - DNA, 340 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12384 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctgtgggacgcacgaggatgttaacggttcagttcacgctcggctggcctttgtacttag

SEQ ID NO: 12385 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 12386 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccatgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12387 - DNA, 330 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 12388 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12389 - DNA, 356 bp, Artificial
  Mutation in BnaA.FAD2.a introduced by TALE nuclease pair BnFAD2_T02
cctctcctccctcacctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12390 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggccatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggccgttggacttag

SEQ ID NO: 12391 - DNA, 356 bp, Artificial
  Mutation in BnaA.FAD2.a introduced by TALE nuclease pair BnFAD2_T02
cctctcctccctcaccctctatcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcgagtggtacggcaagtacctcaacaaccctttgggacgcaccgtgatgttaacggttcagttcactctcggctggcctttgtacttag

SEQ ID NO: 12392 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggctggcctttgtacttag

SEQ ID NO: 12393 - DNA, 356 bp, Artificial
  Mutation in BnaA.FAD2.a introduced by TALE nuclease pair BnFAD2_T02
cctctcctccctcaccctctctcctacttcgcctggcctctctacttggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12394 - DNA, 415 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgagtgcggccaccacgccttcagcgactaccagtggctggacgacaccgtcggcctcatcttccactccttcctcctcgtcccttacttctcctggaagtacatctcaactctcccgccaccgtgagcaaggcctccagagcgcgtgcgccggaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12395 - DNA, 387 bp, Artificial
  Mutation in BnaA.FAD2.a introduced by TALE nuclease pair BnFAD2_T02
cctctcctccctcaccctctctcctacttcgcctagcctctctactgggcctgccaagggtgcgccctaaccggcgtctgggtcatagcccacgagtgcggccaccacgccttcagcgactaccagtggctggacgacaccgtcggcctcatcttccactccttcctcctcgtcccttacttctcctggaaggcgatggccaccacctgctccggggtcacagtcatcgacgccaccattccaacactggctccctcgagagagacgaagtgtttgtccccaagaagaagtcagacatcaagtggtacggctagtacccgaacgcgcctgagggacgcaagatgatgttaacggttcagttccctctcggctggcctttgtacttag

SEQ ID NO: 12396 - DNA, 354 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12397 - DNA, 356 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12398 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtcgtacggcgagtacctcagcgtccgttggggacgagcggtggtgttaacggctcatttcgctctcgcctgccatttgtacttag

SEQ ID NO: 12399 - DNA, 417 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggcaaccacgccttcagcgaccaccagtggctggacgacgccgtgggcctcgtcttccactccttcctcctcgtcccttacttctcctggaagtaggggaagccgaagtttccaaaaggtcgttgatcaaagctcgccgcgttgtttcatcaagcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 12400 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 12401 - DNA, 357 bp, Artificial
  Mutation in BnaA.FAD2.a introduced by TALE nuclease pair BnFAD2_T02
cctctcctccctcaccctctcccttacctcgccttgcccctctactgcgcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcatgtacaccaaaacctctttcggcagcatcgtgatggtaacagtgccgttcactcccggcggccctttgtccttag

SEQ ID NO: 12402 - DNA, 291 bp, Artificial
  Mutation in BnaA.FAD2.a introduced by TALE nuclease pair BnFAD2_T02
actctcctccctcaccctctctcctacttcgcctggcctctctactgggcctgccagggctgcgtcctaaccggcgtctgggtcatagcccacgagtgcggccaccacgccttcagcgactaccagtggctggacgccaccattccaacactggctccctcgagagagacgaagtgttcgtccccaagaagaagtcagacatcaagtggtacggcaagtacctcaacaaccctttgggacgcaccgtgatgttaacggttcatttcactctcggctggcctttgtacttag

SEQ ID NO: 12403 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12404 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12405 - DNA, 358 bp, Artificial
  Mutation in BnaA.FAD2.a introduced by TALE nuclease pair BnFAD2_T02
cctctcctccctcaccctctctcctacttcgccttgcctctctactgcgcctgccagggctgcgtcctaaccggcgtctgggtcatagcccacgagtgcggccaccacgacttcagcgactgccagtggctttacgacaccgtcggtctcatcttccactccttcctcctcgtcccttacttctcctggaacagtcatcgaggcaaccattccaacactgtctccctcgagagagacgaagtgttggtccccaagaagaagtcaaacataaagtggtacggcaagtacctaaacaaccttctgggacgcacagtgctgttaacggttcatttcattctggcctgccatttgcacttag

SEQ ID NO: 12406 - DNA, 356 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccattggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12407 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacatccctttgggacgcaccgtgatgttaacggttcagttcactcccggctggcctttgtacttag

SEQ ID NO: 12408 - DNA, 360 bp, Artificial
  Mutation in BnaA.FAD2.a introduced by TALE nuclease pair BnFAD2_T02
cctctcctccctcaccctctctcctacttcgcctggcctatctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctgaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12409 - DNA, 310 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccaccattccaacactggcttcctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12410 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 12411 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12412 - DNA, 355 bp, Artificial
  Mutation in BnaA.FAD2.a introduced by TALE nuclease pair BnFAD2_T02
cctctcctccctcaccctctctcctacttcgcctggcctcactactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgcaaccattccaacactggctccctcgagagagacgaagtgtttgtccccaagaagaagtcaggcatcaagtggtacggcaagtacctcaacaaccctttgggacgcaccgtgatgttaacggttcagttcactctcggctggcctttgtacttag

SEQ ID NO: 12413 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12414 - DNA, 323 bp, Artificial
  Mutation in BnaA.FAD2.a introduced by TALE nuclease pair BnFAD2_T02
cctctcctccctcaccctttctcctacttcgcctggcccctctcctgggcctgccaaggctgcgtcctaacgggcctctgggtcatcgcccacgaatgctgccaccacgccttcagcgactaccagtggctggacgacaccgtcggcctcatcttccactccttcctcctcgtcccttacttctcctggaagtaccgctcgccgcagccgaacgaccgagaagaagtcagacatcaagtggtacggcaagtacctcaacaaccctttgggacgcaccgtgatgttaacggttcagttcactcgcgggtggcctttgtacttag

SEQ ID NO: 12415 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12416 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccttgatgttaacggttcagttcactctcggctggcctttgtactag

SEQ ID NO: 12417 - DNA, 437 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaccgtctccagcggctgttgccggtgctgtgccaggcccacggcttgaccccggagcaggtggtggccatcgccatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12418 - DNA, 356 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatcgcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgccctgtgatgttaacggttcaggtcactctcggctggcatttgcacttag

SEQ ID NO: 12419 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 12420 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaacaaacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 12421 - DNA, 357 bp, Artificial
  Mutation in BnaA.FAD2.a introduced by TALE nuclease pair BnFAD2_T02
cctctcctccctcaccctctctcctacttcgcctggcctctctcatgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12422 - DNA, 360 bp, Artificial
  Mutation in BnaA.FAD2.a introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12423 - DNA, 391 bp, Artificial
  Mutation in BnaA.FAD2.a introduced by TALE nuclease pair BnFAD2_T02
cctctcctccctcaccctctctactacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcatcttccactccttccaccaccagcaatattggtggcaagcaggcgctggagacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12424 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttactcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 12425 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggatgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12426 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactcccggctggcctttgtacgtag

SEQ ID NO: 12427 - DNA, 359 bp, Artificial
  Mutation in BnaA.FAD2.a introduced by TALE nuclease pair BnFAD2_T02
cctctcctccctcaccctctctcctacttcgcctggccacactactgggcctgccagggctgcgtcgtaaccggcgtctgggtcatagcccacgagtgcggccaccacgccttcagcgactaccagtggctggacgacaccctcggcctcatcttccactccttcctcctcgtcccttacttctcctggaagtagtcatcgacgccaccattccaacactggctccctcgagagagacgaagtgtttgtccccaagaagaagtcagacatcaagtgatacggcaagtacctcaacagccttttgggacgcaccgtgtttttaacggttcagttccctcccggatggccgtcgtacttag

SEQ ID NO: 12428 - DNA, 414 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggagaccccccagcaggtggtggccatcgccagcaataatggtggcaagcaggcgctggagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12429 - DNA, 344 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttactcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 12430 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12431 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctccttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12432 - DNA, 357 bp, Artificial
  Mutation in BnaA.FAD2.a introduced by TALE nuclease pair BnFAD2_T02
cctctcctccctcaccctctcccttacctcgcctggaccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaaagtcatcgacgccaccattccaacactggctccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 12433 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccactacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12434 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12435 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12436 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtcatcgacgccaccattccaacactggctccctcgagagagacgaagtgtttgtccccaagaagaagtcagacatcaagtggtacggcaagtacctaaacagccctgtgggccgcaccgtgaggttatcggttcagttcactcctggttggcctttgtccgtag

SEQ ID NO: 12437 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttaattctcctggacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12438 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 12439 - DNA, 363 bp, Artificial
  Mutation in BnaA.FAD2.a introduced by TALE nuclease pair BnFAD2_T02
cctctcctccctcaccctctatcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12440 - DNA, 370 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtaagaaaaatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12441 - DNA, 356 bp, Artificial
  Mutation in BnaA.FAD2.a introduced by TALE nuclease pair BnFAD2_T02
cctctcctccctcaccctctctcctactttgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 12442 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttaacgacaccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12443 - DNA, 322 bp, Artificial
  Mutation in BnaA.FAD2.a introduced by TALE nuclease pair BnFAD2_T02
cctctctccctcaccctctcccttacctcgcctggcccctctactgggcctgccaaggctgcgtcctaacgggcctctgggtcatagcccacgagcgcggccaccacgccttcagcgactaccagtggctggacgacaccgtcggcctcatcttccactccttcctcctcgtcccttacttctcctggaagtaccgctcgccgcagccgaacgaccgagaagaagtcagacatcaagtggtacggcaagtacctcaacaaccctttgggacgcaccgtgatgttaacggttcagttcactctcggctggcctttgtacttag

SEQ ID NO: 12444 - DNA, 358 bp, Artificial
  Mutation in BnaA.FAD2.a introduced by TALE nuclease pair BnFAD2_T02
cctctcctccctcaccctctctcctacttcgcctggcccctctactgggcctgccacggctgcgtcctaaccggcgtctgggtcatcgcccacgagtgcggccaccacgccttcagccactaccagtggctggacgacaccgtcggcctcgtcttccactccttcctcctcgtccctttcttctcctggaagagtcatcgacgccaccattccaacactggctccctcgagagggatgaagtgttcgtccccaagaagaaatccgacatcaagtggtacggcaagtacctcaacaacccgctgggacgcacggtgatgttaacggttcagttcactctcggctggcctttgtacttag

SEQ ID NO: 12445 - DNA, 351 bp, Artificial
  Mutation in BnaA.FAD2.a introduced by TALE nuclease pair BnFAD2_T02
cctctcctccctcaccctctctactacttcgcctggcccctctcctcggcctgccagggctgcgtcctaacgagcctctgggtcatcgcccacgaatgcgcccaccacgccttcagcgactaccagtggcttgacgacaccgtcggcctcatctcccactccttcctcctcttcccttacttctccatcatcgacgccaccattccaacactcgctccctcgagagagacgaagtgtttgtccccaagaagaagtcagacatcaagtggtacggcaagtacctcaacaaccctttgggacgcaccgtgatgttaacggttcagttcactcgagcctggcctttgtacgtag

SEQ ID NO: 12446 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcctggaaggtcatcgacgccaccattccaacactggctccctcgagagagacgaagtgtttgtccccaagaagaagtaagacatcaagtggtacggcaagtacctcaacaaccctttgggacgcaccgtgatgttaacggttcagttcactctcggctggcctttgtacttag

SEQ ID NO: 12447 - DNA, 321 bp, Artificial
  Mutation in BnaA.FAD2.a introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagagagacgaagtgtttgtccccaagaagaagtcagacatcaagtggtacggcaagtacctcaacaaccctttgggacgcaccgtgatgttaacggttcagttcactcccggctggcctttgtacttag

SEQ ID NO: 12448 - DNA, 348 bp, Artificial
  Mutation in BnaA.FAD2.a introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12449 - DNA, 415 bp, Artificial
  Mutation in BnaA.FAD2.a introduced by TALE nuclease pair BnFAD2_T02
cctctcctccctcaccctctcccttacctcgcctggcccctctactgcgcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacatctcaactctcccgccaccgtgagcaaggcctccagagcgcgtgcgccggaccagtcatcgacgccaccattccaacactggctccctcgagagagacgaagtgtttgtccccaagaagaaatccgacatcaagtggtacggcaagtgcctcaacagccctttgtgacgcaccgagatgttaacggttcagtgcactcgcggcaggcctttgcacttag

SEQ ID NO: 12450 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgcgcggctggcctttgtacttag

SEQ ID NO: 12451 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatagcccacgagtgcggccaccacgccttcagcgactaccagtggcttgacgacaccgtcggtctcatcttccactccttcctcctcgtcccttacttctcctggcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12452 - DNA, 411 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcctctgggtcatcgcccacgaatgcggccaccacgccttcagcgaccaccagtggctggacgacgccgtgggcctcgtcttccactccttcctcctcgtcccttacttctcctggaagtacagagcgaggtatgtaggcggtgctacagagttcttgaagtggtggcctacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 12453 - DNA, 353 bp, Artificial
  Mutation in BnaA.FAD2.a introduced by TALE nuclease pair BnFAD2_T02
cctctcctccctcaccctctctcctacttcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12454 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttatacttag

SEQ ID NO: 12455 - DNA, 347 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttatccatgacgccaccattccaacactggctccctcgagagagacgaagtgtttgtccccaagaagaagtcagacatcaagtggtacggcaagtacctcaacaaccctttgggacgcacagtgatgttaacggttcagttcactctcggctggcctttgtacttag

SEQ ID NO: 12456 - DNA, 355 bp, Artificial
  Mutation in BnaA.FAD2.a introduced by TALE nuclease pair BnFAD2_T02
cctctcctccctcaccctctatactacttcgcctggcctctcacatgcgcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtgttacggcaaggtcctcaacggccctttgggacgcactgtggtgtgaacggttcaggtcagtcgcgggtggccttggtacttag

SEQ ID NO: 12457 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggccggacgacaccgtcggcctcatcttccactccttcctcctcgtcccttacttctcctggaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12458 - DNA, 363 bp, Artificial
  Mutation in BnaA.FAD2.a introduced by TALE nuclease pair BnFAD2_T02
cctctcctccctcaccctgtctcctacttcgcctggcctctctcctcggcctgccagggctgcgtcctaacaggcgtctgggtcatagcccacgagtgcggccaccacgccttcagcgactaccagtggctggacgacaccgtcggcctcatcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcaattcacgctcggctggcctttgcacttag

SEQ ID NO: 12459 - DNA, 352 bp, Artificial
  Mutation in BnaA.FAD2.a introduced by TALE nuclease pair BnFAD2_T02
cctctcctccctcaccctctctcctacttctcctggcctctctactgggcctgccagggcttcgtcctaaccggcgtctgggtcatagcccacgagtgctgccaccacgccttcagcgactaccagtggctggacgacaccgtcggcctcatcttccactccttcctcctcgtcccttacttctccagtcatcgacgccaccattccaacactggctccctcgagagagacgaagtgtttgtccccaagaagaagtcagacatcaagtgctccgccaagtacctcaacaaccctttgggacgcaccgtgaggctaacggttcagttcactcccggctgccctttggacttag

SEQ ID NO: 12460 - DNA, 401 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggcgctggagacggtccagcggctgttgccggtgctgtgccaatagtcatcgacgccaccattccaacactggctccctcgagagagacgaagtgtttgtccccaagaagaagtcagacatcaagtggtacggcaagtacctcaacaaccctttgggacgcagcgtgatgttaacggttcagttcactctcggctggcctttgtacttag

SEQ ID NO: 12461 - DNA, 356 bp, Artificial
  Mutation in BnaA.FAD2.a introduced by TALE nuclease pair BnFAD2_T02
cctctcctccctcaccctatctcctacttcgcctggactctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 12462 - DNA, 364 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12463 - DNA, 353 bp, Artificial
  Mutation in BnaA.FAD2.a introduced by TALE nuclease pair BnFAD2_T02
cctctcctcctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactcctcctggaacatcgacgccaccattccaacactggctccctcgagagagacgaagtgtttgtccccaagaagaaatccgacatcaagtggtacggaaagtacctcaacaacccgctaggacgcatggtgatgctaaccgtccagttcacgctcggctggcctttgtacttag

SEQ ID NO: 12464 - DNA, 356 bp, Artificial
  Mutation in BnaA.FAD2.a introduced by TALE nuclease pair BnFAD2_T02
cctctcctccctcaccctctcccttacatcgcctggcccatctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacataaagtggtacggcaagtacctcaacaaccctttgggacgcaccgtgatgttaacggttcagttcactcgcggctggcctttgtacttag

SEQ ID NO: 12465 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12466 - DNA, 330 bp, Artificial
  Mutation in BnaA.FAD2.a introduced by TALE nuclease pair BnFAD2_T02
cctctcctccctcaccctataccttacctcgcctggcccctctactgggcctgccaaggctgcgtcctaacgggcctctgggtcatcgcccacgaatgcggccaccacgccttcagcgaccaccagtggctggacgacgccgtgggcctcatcttccactccttcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttggacttag

SEQ ID NO: 12467 - DNA, 330 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggctggcctttgtacttag

SEQ ID NO: 12468 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 12469 - DNA, 294 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctccttgtcaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12470 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12471 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcgacgccaccattccaacactggctccctcgagagagacgaagtgtttgtccccaagaagaagtcagacatcaagtggtacggcaagtacctcaacaaccctttgggaagaaccgtgatgttaacggttcatttcactcgcgcctgccatttgtatttag

SEQ ID NO: 12472 - DNA, 357 bp, Artificial
  Mutation in BnaA.FAD2.a introduced by TALE nuclease pair BnFAD2_T02
cctctcctccctcaccctttctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgcgatgttaacggttaagttcactcgcgcctggcaataatacttag

SEQ ID NO: 12473 - DNA, 356 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcccggctggcctttgtacttag

SEQ ID NO: 12474 - DNA, 363 bp, Artificial
  Mutation in BnaA.FAD2.a introduced by TALE nuclease pair BnFAD2_T02
cctctcctccctcaccctctctcctacttcgcctggcctatctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12475 - DNA, 358 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 12476 - DNA, 352 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12477 - DNA, 341 bp, Artificial
  Mutation in BnaA.FAD2.a introduced by TALE nuclease pair BnFAD2_T02
cctctcctccctcaccctctctcctacttcgcctggcccctctcctcagcctgccagggctgcgtcctaaccggcgtctgggtcatagcccacgagtgcggccaccacgccttcagcgactaccagtggctggacgacaccgtcggcctcatcttccactccttcctcctcgtccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12478 - DNA, 315 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 12479 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggcaaccacgccttcagcgactaccagtggctggacgacaccgtcggcctcatcttccactccttcctcctcgtcccttacttctcctggaagtaccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12480 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccttttgggacgcaccgtgatgttaacggttcagttcactcgcggctggccttagtacttag

SEQ ID NO: 12481 - DNA, 387 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaggcgatggccaccacctgctccggggtcacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12482 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgagtcacgttatgacccccgccgatgacgcgggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12483 - DNA, 274 bp, Artificial
  Mutation in BnaA.FAD2.a introduced by TALE nuclease pair BnFAD2_T02
cctctcctccctcaccctctatcctacttcgcctcgcctctctactgggcctgccagggctgcgtcctaacgggcctctgggtcatcgcccacgaatgcggccaccacgccttcagcgaccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 12484 - DNA, 357 bp, Artificial
  Mutation in BnaA.FAD2.a introduced by TALE nuclease pair BnFAD2_T02
cctctcctccctcaccctctcccttacctcgcctggaccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12485 - DNA, 391 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtaggcgctaaatgaaaccttaacgctatggaacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 12486 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 12487 - DNA, 341 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtccagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 12488 - DNA, 365 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaaccggcgtctgggtcatagcccacgagtgcggccaccacgccttcagcgactaccagtggctggacgacaccgtcggtctcatcttccactccttcctcctcgtcccttacttctcctggaagtacaaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12489 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 12490 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12491 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccatgccttcagcgactaccagtggcttgacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12492 - DNA, 464 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggccttggtaggtccagcggcggaggaactctttgatccggttcctgaacaggatctatttgaggcctttttacggttcctggccttttgctggccttttgctcacatgtcatcgacgccaccattccaacactggctccctcgagagagactaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12493 - DNA, 356 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcctctgggtcatcgcccacgaatgcggccaccacgccttcagcgaccaccagtggctggacgacgccgtgggcctcgtcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12494 - DNA, 430 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacaccgtcggcctcatcttccactccttcctcctcgtcccttacttctcctggaagtgggtggctcgagggttatttgccgactaccttggtgatcttctagtgtagccgtagttaggccaccacttcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12495 - DNA, 332 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12496 - DNA, 382 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcctggaagtctccagcggctgttgccggtgccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12497 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctgaccggcgtctgggtcatagcccacgagtgcggccaccacgccttcagcgactaccagtggctggacgacaccgtcggcctcatcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12498 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctattccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12499 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 12500 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggccatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12501 - DNA, 423 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaatagtcttccgactgagcctttcgttttatttgatgcctggcagttccctactctcgcgttcgaatacatcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 12502 - DNA, 345 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttcttcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12503 - DNA, 357 bp, Artificial
  Mutation in BnaA.FAD2.a introduced by TALE nuclease pair BnFAD2_T02
cctctcctccctcaccctctctcctacttcgcctggcctctctactgagcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatgtcatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 12504 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12505 - DNA, 312 bp, Artificial
  Mutation in BnaA.FAD2.a introduced by TALE nuclease pair BnFAD2_T02
cctctcctccctcaccctctcccttacctcgcctggcccctctactgggcctgccaagggtgcgtcctaaccggcgtctgggtcatagcccacgagtgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12506 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtggtgttaacggttcagttcactctcggctggcctttgtacttag

SEQ ID NO: 12507 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12508 - DNA, 383 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtttgaccccggagcaggtggtggccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 12509 - DNA, 392 bp, Artificial
  Mutation in BnaA.FAD2.a introduced by TALE nuclease pair BnFAD2_T02
cctctcctccctcaccctctcccttacctcgcctggccactctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacagcaccggcaacagccgctggaccgtctccagcgcctgcttgccaccattccaacactggctccctcgagagagacgaagtgtttgtccccaagaagaagtcagacatcaagtggtacggcaagtacctcaacacccctttgggacgcaccgggatgttaacggttcagttcactctcggctggcctttgtacttag

SEQ ID NO: 12510 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12511 - DNA, 453 bp, Artificial
  Mutation in BnaA.FAD2.a introduced by TALE nuclease pair BnFAD2_T02
cctctcctccctcaccctctcccttacctcgcctggcccctctactgggcctgtcaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagcgctacggctgttgccggtgctgtgccaggcccacggcttgaccccccagcaggtggtggccatcgccagcaatggcggtggcaagcaggcgctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12512 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcttttgtactag

SEQ ID NO: 12513 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcgagtggtacggcaagtacctcaacaaccctttgggacgcaccgtgatgttaacggttcagttcactctcggctggcctttgtacttag

SEQ ID NO: 12514 - DNA, 340 bp, Artificial
  Mutation in BnaA.FAD2.a introduced by TALE nuclease pair BnFAD2_T02
cctctcctccctcaccctctctcctacttcgcctggcccctctactgggcctgccagggctgcgtcctaaccggcgtctgggtcatagcccacgagtgcggccaccacgccttcagcgactaccagtggcttgacgacaccgtcggtctcatcttccactccttcctcctcgtcagtcatcgacgccaccattccaacactggctccctcgagagagacgaagtgtttgtccccaagaagaagtcagatatcaagtggtacggcaagtacctcaacaaccctttgggacgcaccgtgatgttaacggttcagttcactctcggctggcctttgtacttag

SEQ ID NO: 12515 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12516 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtgcctcaacaaccctttgggacgcaccgtgatgttaacggttcagttcactcgcggctggcctttgtacttag

SEQ ID NO: 12517 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttcatcgacgccaccattccaacactggctccctcgagagggatgaagtgttcgtccccaagaagaaatccgacatcaagtggtacggaaagtacctcaacaacccgctaggacgcacggtgatgctaaccgtccaggtcacgcgcggctggccttagtacttag

SEQ ID NO: 12518 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 12519 - DNA, 458 bp, Artificial
  Mutation in BnaA.FAD2.a introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcggtccagcggctgttgccaccatcattgctggcgatggccaccacctgctggggggtcaagccgtgggcctggcacagcaccggcaacagccgctggagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12520 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagttccatcgacgccaccattccaacactggctccatcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12521 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttggggcgcaccgtgatgttaccggttcagttcactctcggctggcctttgtacttag

SEQ ID NO: 12522 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaatggttcagttcactctcggctggcctttgtacttag

SEQ ID NO: 12523 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctagtcatcgacgccaccattccaacactggctccctcgagagagacgaagtgcttgtccccaagaagaagtcacacatcgagtggttcggcaggcagctcaacaaccctctgggacggcccgtgaggttaacggttcggttgcggccagcatgccctcagcgactag

SEQ ID NO: 12524 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggtccagttcacgctcggctggcctttgtacttag

SEQ ID NO: 12525 - DNA, 356 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12526 - DNA, 305 bp, Artificial
  Mutation in BnaA.FAD2.a introduced by TALE nuclease pair BnFAD2_T02
cctctcctcctcaccctctctcctacttcgcctggcctctctactgggcctgccagggctgcgtcctaaccggcgtctgggtcatagcccacgagtgcggccaccacgccttcagcgactaccagtggctggacgacaccgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12527 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctacagtcatcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggctggcctttgtacttag

SEQ ID NO: 12528 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtaattag

SEQ ID NO: 12529 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 12530 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgttatgttaacggttcagttcactcgcggctggcctttgtacttag

SEQ ID NO: 12531 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12532 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtgccttgacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 12533 - DNA, 367 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacacacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12534 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12535 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaaggcacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12536 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagtagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12537 - DNA, 358 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcctctgggtcatcgcccacgaatgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12538 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggatcatcgacgccaccattccaacaccggatccctcgagagggatgaagtgttcgtccccaagaagaagtcagacatcaagtggtacggcaagtacctcaacaacccgctaggacgcacggtgatgttaacggttcagttcactctcggctggcctttgtacttag

SEQ ID NO: 12539 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactgactccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12540 - DNA, 359 bp, Artificial
  Mutation in BnaA.FAD2.a introduced by TALE nuclease pair BnFAD2_T02
cctctcctccctcaccctgtcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaagttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12541 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctccttgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12542 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 12543 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12544 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgactaccagtggcttgacgacaccgtcggtctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12545 - DNA, 438 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttctcctggaatccgactgagcctttcgttttatctgttgtttgtcggtgaacgctctcctgagtaggctccgcccccctgacgagcatcacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12546 - DNA, 357 bp, Artificial
  Mutation in BnaA.FAD2.a introduced by TALE nuclease pair BnFAD2_T02
cctctcctccctcaccctctctactacttcgcctggcctctctcctcggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgtgacgcaccgtgatgttaacggttcagttctctcgcggccggcctttgcacttag

SEQ ID NO: 12547 - DNA, 357 bp, Artificial
  Mutation in BnaA.FAD2.a introduced by TALE nuclease pair BnFAD2_T02
cctctcctccctcaccctctcccttacctcgcctggccactctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12548 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacaccaagtggtacggcaagtacctcaacaaccctttgggacgcaccgtgatgttaacggttcagttcactctcggctggcctttgtactag

SEQ ID NO: 12549 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 12550 - DNA, 356 bp, Artificial
  Mutation in BnaA.FAD2.a introduced by TALE nuclease pair BnFAD2_T02
cctctcctccctcaccctctcccttacctcgcctggcctctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12551 - DNA, 324 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgacttcagcgaccaccagtggctggacgacgccgtgggcctcgtcttccactccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12552 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcactctcggctggcctgtgtacttag

SEQ ID NO: 12553 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 12554 - DNA, 355 bp, Artificial
  Mutation in BnaA.FAD2.a introduced by TALE nuclease pair BnFAD2_T02
cctctcctccctcaccctctctcctacttcgcctggcctctctactgagcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctgccctttgtacttag

SEQ ID NO: 12555 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtagctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12556 - DNA, 357 bp, Artificial
  Mutation in BnaA.FAD2.a introduced by TALE nuclease pair BnFAD2_T02
cctctcctccctcaccctctatcctacttcgcctcgcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacatccctttgggacgctccgtgatgttaacggttcagttcactctcggctggcctttgtacttag

SEQ ID NO: 12557 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctgtgggacgcgtctagatgttaacgtttcagttcactctcggctggcctttgtccttag

SEQ ID NO: 12558 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12559 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacaaacagccatcgacgccaccattccaacaccggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 12560 - DNA, 369 bp, Artificial
  Mutation in BnaA.FAD2.a introduced by TALE nuclease pair BnFAD2_T02
cctctcctccctcaccctctcccctacttcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccctacaacctgcccatcggccaggccgacgccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12561 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatcatcgacgccaccattccaacactggctccctcgagagagacgaagtgtttgtccccaagaagaagtcagacatcaagtggtacggcaagtacctaacaaccctttgggacgcaccgtgatgttaacggttcagttcactctcggctggcctttgtacttag

SEQ ID NO: 12562 - DNA, 351 bp, Artificial
  Mutation in BnaA.FAD2.a introduced by TALE nuclease pair BnFAD2_T02
cctctcctccctcaccctctatcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12563 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggtctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12564 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtattgagtgagctgataccgctcgccgcagccgaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12565 - DNA, 345 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 12566 - DNA, 403 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcaagatcgcttggcctcgcgcgcagatcagttggaagaatttgtccgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12567 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12568 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttccgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccctgtacttag

SEQ ID NO: 12569 - DNA, 362 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12570 - DNA, 340 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12571 - DNA, 448 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaagtactccagcgcctgcttgccgccatcgtggctggcgatggccaccacctgctccggggtcaagccgtgggcctggcacagcaccggcaacagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 12572 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12573 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcacacatcaagtggtacggcaagtacctcaacagccctttgggacgcaccgtgatgttaacggttcagttcactctcggctggcctttgtacttag

SEQ ID NO: 12574 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacaccgtcggcctcatcttccactccttcctcctcgtcccttacttctcctggagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12575 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcacagtgatgttaacggttcagttcactctcggctggcctttgtacttag

SEQ ID NO: 12576 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12577 - DNA, 372 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttactcaagtcagaggtggcgaaacccgacagtcatcgacgccaccattccaacactggctccctcgatagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12578 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12579 - DNA, 357 bp, Artificial
  Mutation in BnaA.FAD2.a introduced by TALE nuclease pair BnFAD2_T02
ccctcctccctcaccctctctactacttcgcctggcctctctactgggcctgccaagggtgcgtcctaaccggcgtctgggtcatagcccacgagtgcggccaccacgccttcagcgaccaccagtggctggacgacgccgtgggcctcgtcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12580 - DNA, 292 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12581 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12582 - DNA, 341 bp, Artificial
  Mutation in BnaA.FAD2.a introduced by TALE nuclease pair BnFAD2_T02
cctctcctccctcaccctctcccttacctcgcctggcatctctactgggcctgccagggctgcgtcctaaccggcgtctgggtcatagcccacgagtgcggccaccacgccttcagcgactaccagtggctggacgacaccgtcggcctcatcttccactccttcctcctcgtccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12583 - DNA, 416 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggacacaggccaacttctcaagattgcaaaacgtggcggcgtgaccgcagtggaggtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcacgctcggctggcctttgtacttag

SEQ ID NO: 12584 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12585 - DNA, 355 bp, Artificial
  Mutation in BnaA.FAD2.a introduced by TALE nuclease pair BnFAD2_T02
cctctcctccctcaccctctctcctacttcgcctggcctctctaccgggcctgccagggctgcgtcctaaccggcgtctgggtcatagcccacgagtgcggccaccacgccttcagcgactaccagtggctggacgacaccgtcggcctcctcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggtacaggtcactctcggctggcctgtgtacttag

SEQ ID NO: 12586 - DNA, 356 bp, Artificial
  Mutation in BnaA.FAD2.a introduced by TALE nuclease pair BnFAD2_T02
cctctcctccctcaccctgtctcctacttcgcctggcctctctactgcgccgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacacccctttgggccgcaccgtgatgttaacggttcagttctctcccggctggccgtagtacttag

SEQ ID NO: 12587 - DNA, 363 bp, Artificial
  Mutation in BnaA.FAD2.a introduced by TALE nuclease pair BnFAD2_T02
cctctcctccctcaccctctctcctacttcgcctagcctctctactcggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12588 - DNA, 350 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12589 - DNA, 340 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactag

SEQ ID NO: 12590 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12591 - DNA, 358 bp, Artificial
  Mutation in BnaA.FAD2.a introduced by TALE nuclease pair BnFAD2_T02
cctctcctccctcaccctctctcctacttcgcctggcctctctactgtgcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaccccgctagggcgcacggggatgctaaccgtccagtgcacgctcggctggcctttgtacttag

SEQ ID NO: 12592 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtaccccaacacccctttgggacgcaccgtgatgttaacggttcagttctctctcggctggcctttgtacttag

SEQ ID NO: 12593 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12594 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 12595 - DNA, 389 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacagcaacgtcggttcgagatggcgctcgaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12596 - DNA, 329 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12597 - DNA, 339 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12598 - DNA, 332 bp, Artificial
  Mutation in BnaA.FAD2.a introduced by TALE nuclease pair BnFAD2_T02
cctctcctccctcaccctctctcttacctcgcctggcccctctactgggcctgccaaggctgcgtcctaaccggcctctgggtcatcgcccacgaatgcggccaccacgccttcagcgactaccagtggcttgacgacaccgtcggcctcatcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12599 - DNA, 357 bp, Artificial
  Mutation in BnaA.FAD2.a introduced by TALE nuclease pair BnFAD2_T02
cctctcatccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12600 - DNA, 357 bp, Artificial
  Mutation in BnaA.FAD2.a introduced by TALE nuclease pair BnFAD2_T02
cctctcatccctcaccctctctcctacttcgtctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacgacaagtacctcaacagccctttgggacgcaccgagatgttaacgggtcagttctctctcggccggcctttatacttag

SEQ ID NO: 12601 - DNA, 335 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttactcaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12602 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 12603 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgagtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcgagtggtacggcaagtacctcaacaaccttttgggacgcaccgtgatgttaacggttcagttcactctcggctggcctttgtacttag

SEQ ID NO: 12604 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacatcgacgccaccattccaacactggctccctcgagagatacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 12605 - DNA, 354 bp, Artificial
  Mutation in BnaA.FAD2.a introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12606 - DNA, 391 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtgtaggtcgttcgctccaagctgggctgtgtgcacgaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcccggctggcctttgtacttag

SEQ ID NO: 12607 - DNA, 358 bp, Artificial
  Mutation in BnaA.FAD2.a introduced by TALE nuclease pair BnFAD2_T02
cctctcctccctcaccctctctcctacttcgcctggcctctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12608 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaatcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12609 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 12610 - DNA, 273 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12611 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 12612 - DNA, 356 bp, Artificial
  Mutation in BnaA.FAD2.a introduced by TALE nuclease pair BnFAD2_T02
cctctcctccctcaccctctatactacttcgcctggcctctctactgggcctgccaaggctgcgtcctaacgggcctctgggtcatcgcccacgaatgcggcaaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12613 - DNA, 357 bp, Artificial
  Mutation in BnaA.FAD2.a introduced by TALE nuclease pair BnFAD2_T02
cctctcctccctcaccctctctcctacttcgcctcgcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacagccctttgggacgcagcgtgatgttaacagttcagttcactctcggctggcctttgtacttag

SEQ ID NO: 12614 - DNA, 357 bp, Artificial
  Mutation in BnaA.FAD2.a introduced by TALE nuclease pair BnFAD2_T02
cctctcctccctcaccctctcccttacctcggctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12615 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaacccttagggacgcaccgtgatgttaacggttcagttcactctcggctggcctttgtacttag

SEQ ID NO: 12616 - DNA, 401 bp, Artificial
  Mutation in BnaA.FAD2.a introduced by TALE nuclease pair BnFAD2_T02
cctctcctccctcaccctctaccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtactgcccgctttccagtcgggaaacctgtcgtgccagctgcaagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12617 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgctgccaccacgccttcagcgactaccagtggctggacgacaccgtcggcctcatcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 12618 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctacgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12619 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 12620 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 12621 - DNA, 323 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccgctcgccgcagccgaacgaccgagaagaagtcagacatcaagtggtacggcaagtacctcaacaaccctgtgggacgcaccgtgatgttaacggttcagttcactctcggctggcctttgtacttag

SEQ ID NO: 12622 - DNA, 372 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttactcaagtcagaggtggcgaaacccgacagtcatcgacgccaccattccaacaccggatccctcgagagggatgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 12623 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagctactaccagtggctggacgacaccgtcggcctcatcttccactccttcctcctcgtcccttacttctcctggaagtaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12624 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12625 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtccattacttctcctggaagtgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 12626 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtacacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactcgcggctggcctttgtacttag

SEQ ID NO: 12627 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggaaagtacctcaacaacccgctaggacgcacggtgatgctaaacgtgcagttcacgctcggctgccctttgtacttag

SEQ ID NO: 12628 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacaccggatccctcgagagggatgaagtgttcgtccccaagaagaaatccgacatcaagtggtacggaaagtacctcaacaacccgctaggacgcacggtgatgctaacggtccagttcacgctcggctggcctttgtacttag

SEQ ID NO: 12629 - DNA, 356 bp, Artificial
  Mutation in BnaA.FAD2.a introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtaccgcaacatcccatgggtattcaccgtgttgttaacggttcagttctctcgcggctgccctttttacgtag

SEQ ID NO: 12630 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttttacttag

SEQ ID NO: 12631 - DNA, 348 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12632 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 12633 - DNA, 318 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12634 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12635 - DNA, 364 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacatcccgttgggacgcaccgtgatgttaacggttcagttcactctcggctggcctttgtacttagctttag

SEQ ID NO: 12636 - DNA, 310 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12637 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12638 - DNA, 290 bp, Artificial
  Mutation in BnaA.FAD2.a introduced by TALE nuclease pair BnFAD2_T02
cctctcctccctcaccctctctcctacttcgcctggcccctctactgggcctgccagggctgcgtcctaaccggcgtctgggtcatagcccacgagtgcggccaccacgccttcagcgactaccagtggctggacgacaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttttacttag

SEQ ID NO: 12639 - DNA, 391 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtaggtcgttcgctccaagctgggctgtgtgcacgaatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 12640 - DNA, 387 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtccctttgcctggcacagcaccggcaacagccgctggaccgtctccagctgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12641 - DNA, 315 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaacgggcctctgggtcatcgcccacgaatgcggccaccacgccttcagcgaccaccaatggcggtggcaagcaggcgctggagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 12642 - DNA, 389 bp, Artificial
  Mutation in BnaA.FAD2.a introduced by TALE nuclease pair BnFAD2_T02
cctctcctccctcaccctctctcctacttcgcctggcctctctactgtgactgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacagcaacgtcggttcgagatggcgctcgaagtcatcgacgccaccattccaacactggctccctcgagagagacgaagtgtttgtccccaagaagaagtcagacatcaagtggcacggcaagtaccccaacaccccttagggatggacggtgctgttacccgttcagttccctctcggctggcctttgtacttag

SEQ ID NO: 12643 - DNA, 362 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12644 - DNA, 319 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12645 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctaaacaaccctttgggacgcaccgtgatgttaaccgttcagttcactctcggctggcctgtgtgcttag

SEQ ID NO: 12646 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctaatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12647 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 12648 - DNA, 357 bp, Artificial
  Mutation in BnaA.FAD2.a introduced by TALE nuclease pair BnFAD2_T02
cctctcctccctcaccatctctcctacttcgcctggcctctctactgggcctgccagggctgcgtcctaaccggcgtctgggtcatcgcccacgaatgcggccaccacgccttcagcgaccaccagtggctggacgacgccgtgggcctcgtcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12649 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12650 - DNA, 360 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacgccgtgggcctcgtcttccactccttcctcctcgtcccttacttctcctggaagtaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12651 - DNA, 358 bp, Artificial
  Mutation in BnaA.FAD2.a introduced by TALE nuclease pair BnFAD2_T02
cctctcctccctcaccctctccattacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagagccatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 12652 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12653 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctgatcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 12654 - DNA, 363 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatacagtcatcgacgccaccattccaacactggctccctcgagagagacgaagtgtttgtccccaagaagaagtcatacatcaagtggtacggcaagtacctcaacaaccctttgggacgcaccgtgatgttaacggttcagttcactctcggctggcctttgtacttag

SEQ ID NO: 12655 - DNA, 360 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtaagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12656 - DNA, 411 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggagtcttcatgaaggtgtacggctacaggggcaagcacctgggcggctccaggaagcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12657 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12658 - DNA, 329 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactaccagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12659 - DNA, 356 bp, Artificial
  Mutation in BnaA.FAD2.a introduced by TALE nuclease pair BnFAD2_T02
cctctcctccctcaccctctctcctacttcgcctggccctctactgggcctgccagggctgcgtcctaaccggcgtctgggtcatagcccacgagtgcggccaccccgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12660 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaccgctcgccatgcatgcactgcctccactgcggtagtcatcgacgccaccattccaacactggctccctcgagagagacgaagtgtttgtccccaagaagatgtcagacatcaagtggtacggcaagtacctcaacaaccctttgggacgcaccgtgatgttaacggttcagttcactctcggctggcctttgtacttag

SEQ ID NO: 12661 - DNA, 356 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcgcttacttctcctggaagccatcgacgccaccattccaacactggctccctcgagagagacgaagtgtttgtccccaagaagaagtcagacatcaagtggtccggcaagtccctcaacaagcctttgggacgtaccgtgctgttaacgcttcagttccctctcggctggcctttgtacttag

SEQ ID NO: 12662 - DNA, 418 bp, Artificial
  Mutation in BnaA.FAD2.a introduced by TALE nuclease pair BnFAD2_T02
cctctcctccctcaccctttctactacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaggggaagccgaagtttccaaaaggtcgttgatcaaagctcgccgcgttgtttcatcaagcccatcgacgccaccattccaacactggctccctcgagggagacgaagtgtttgtccccaagaagaaatcagacatcaagtggtacggcaagtacctcaacagcccagtggaacgcaccgtgatgttaacggttgagttcactctctgctggcagatatgcttag

SEQ ID NO: 12663 - DNA, 356 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgcgagagacgaagtgtttgtccccaagaagaagtcaaacatcaagtggtacggcgagtacctcaacaaccctctgggacgcaccgtgatgttaacggttcaggtcactctcggctggcctttgtacttag

SEQ ID NO: 12664 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12665 - DNA, 358 bp, Artificial
  Mutation in BnaA.FAD2.a introduced by TALE nuclease pair BnFAD2_T02
cctctcctccctcaccctctcccttacctcggctggcccctctactgggcctgccaaggctgcgtcctaacgggcctcttggtcatcgcccacgaatgcggccaccacgccttcagcgaccaccagtggctggacgacgccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12666 - DNA, 354 bp, Artificial
  Mutation in BnaA.FAD2.a introduced by TALE nuclease pair BnFAD2_T02
cctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12667 - DNA, 346 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggcgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12668 - DNA, 354 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggccgacaccgtcggcctcatcttccactccttccccctcgtcccttacttctcctggaacctcgacgccaccattccaacactggctccctcgcgggagacgaagtgtttgtccccaagaggaagtcagacatcgagtggcacggcgaggacctcaacacccctctggaacgccctgtgatgttaacgttgcaggtcactctcgcctggcattagcacgtag

SEQ ID NO: 12669 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaagtaaaagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12670 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12671 - DNA, 363 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12672 - DNA, 312 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12673 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacagccctgtgggacgcaccgtgatgttaacggttcagttcactctcggctggcctttgtacttag

SEQ ID NO: 12674 - DNA, 362 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcctggaagttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12675 - DNA, 358 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtgtcatcgacgccaccattccaacactggctccctcgagagagacgaagtgtttgtccccaagaagaagtcagacatcaagtggtacggcaagtacctcaacaaccctgtgggacgcgccgtgatgttaacggttcagttcactctcggctggcctttgtacttag

SEQ ID NO: 12676 - DNA, 443 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtaggcgatggccaccacctgctccggggtcaagccgtgggcctggcacagcaccggcaacagcgcctgaaccgtctccagcgcctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12677 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtttcatcgacgccaccattccaacactggctccctcgagagagacgaagtgtttgtccccaagaagaaatccgacatcaagtggtacggaaagtgcctcatcatcccgctaggacggacggtgatgctaaccgtctagttcacgctcggctggcctttgtgcttag

SEQ ID NO: 12678 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctacctcgagagagacgaagtgtttgtccccaagaagcagtcagacatcaagtggtacggcaagtacctcaacaaccctttgggacgcaccgtgatgttaacggttcagttcactctcggctggcctttgtacttag

SEQ ID NO: 12679 - DNA, 353 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 12680 - DNA, 357 bp, Artificial
  Mutation in BnaA.FAD2.a introduced by TALE nuclease pair BnFAD2_T02
cctcttctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12681 - DNA, 323 bp, Artificial
  Mutation in BnaA.FAD2.a introduced by TALE nuclease pair BnFAD2_T02
cctctcctccctcaccctctctcctacttcgcctggcctctctcctcggcctgcccgggctgcgtcctaaccggcgtctgggtcatagcccacgagtgctgccaccacgccttcagcgactaccagtggctggacgacaccgtcggcctcatcttccactccttcctcctcgtcccttacttctcctggaactaccgctcgccgcagccgaacgaccgagaagaagtcagacatcaagtggtacggcaagtacctcaacatccgtctgggacggactgtgaggttaagcgtacaggtcaggctcggctggcctctgtgcctac

SEQ ID NO: 12682 - DNA, 355 bp, Artificial
  Mutation in BnaA.FAD2.a introduced by TALE nuclease pair BnFAD2_T02
cctctcctccctcaccctctctcctacttcgcctggcctctctactgcgcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12683 - DNA, 341 bp, Artificial
  Mutation in BnaA.FAD2.a introduced by TALE nuclease pair BnFAD2_T02
cctctcctccctcaccctctcccttacctcgtctggcccctctactgggcctgccaaggctgcgccctaacgggcctctgggtcatcgcccacgaatgcggccaccacgccttcagcgaccaccagtggctggacgacgccgtgggcctcgtcttccactccttcctcctcgtcccttacttctcctggaaattccaacactggctccctcgagagagacgaagtgtttgtccccaagaagaagtcagacatcaagtggtacggcaagtacctcaacaacccttaggggcgcaccgtgatgttaacggttcagttcactctcggctggcctttgtacttag

SEQ ID NO: 12684 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12685 - DNA, 358 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactacttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12686 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagttgctggacgacaccgtcggcctcatcttccactccttcctcctcgtcccttacttctcctggaatcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 12687 - DNA, 342 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtccctgtcatcgacgccaccattccaacactggctccctcgagagagacgaagtgtttgtccccaagaagaagtcagacatcaagtggtacggcaagtacctcaacaaccctttgggacgcaccgtgatgttaacggtgcaggtcactctcggctggcctgtgtacttag

SEQ ID NO: 12688 - DNA, 358 bp, Artificial
  Mutation in BnaA.FAD2.a introduced by TALE nuclease pair BnFAD2_T02
cctctcctccctcaccctctctcctacttcgcctcgcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagagtcatcgacgccaccattccaacactggctccctcgagagagacgaagtgtttgtccccaagaagaagtcagacatcaagtggtacggcaagtacctcaacagccctgtgggacgcaccgtgaggttaacggttcagttcactctcggctggcctttgtacttag

SEQ ID NO: 12689 - DNA, 355 bp, Artificial
  Mutation in BnaA.FAD2.a introduced by TALE nuclease pair BnFAD2_T02
cctctcctccctcaccatctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12690 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccatcggcctcatcttccactccttcctcctcgtcccttacttctcctggatacagtcatcgacgccaccattccaacactggctccctcgagagagacgaagtgtttgtccccaagaagaagtcagacatcacgtgttacggcaggtacctcaacaaccctttgggacgcgccgtgatgttaacggttcagttcactctaggctggcctttgtacttag

SEQ ID NO: 12691 - DNA, 292 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgagtgcggccaccacgccttcagcgactaccagtgtgatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12692 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgttacttag

SEQ ID NO: 12693 - DNA, 453 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctactggtcggccacgggtttacacacgcgcacatcgttgcgttaagccaacacccggcagcgttagggaccgtcgctgtcaagtatcaggacatgatcgcagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12694 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 12695 - DNA, 397 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaaatgcccgaggcatagactgtaccccaaaaaaacagtcataagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12696 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcatgtacctcaacaaccctttgggacgcaccgtgatgttaacggttcagttcactctcggctggcctttgtacttag

SEQ ID NO: 12697 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12698 - DNA, 335 bp, Artificial
  Mutation in BnaA.FAD2.a introduced by TALE nuclease pair BnFAD2_T02
cctctcctccctcaccctctctcctacttcgcctgcctatctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12699 - DNA, 354 bp, Artificial
  Mutation in BnaA.FAD2.a introduced by TALE nuclease pair BnFAD2_T02
cctctcctccctcaccctctcccttacctcgccaggcccctctactgggcctgccaaggctgcgtcctaacgggcctctgggtcatcgcccacgaatgcggccaccacgccttcagcgactaccagtggcttgacgacaccgtcggcctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12700 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagacaccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12701 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttaatcgtgtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 12702 - DNA, 330 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcatcgacgccaccattccaacactggctccctcgagagagacgaagtgtttgtccccaagaagaagtcagacatcaagtggtacggcaagtaccccaacaacccttagggacgcaccgtgatgttaacggttccgttccctctcggctggcctttgtacttag

SEQ ID NO: 12703 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 12704 - DNA, 356 bp, Artificial
  Mutation in BnaA.FAD2.a introduced by TALE nuclease pair BnFAD2_T02
cctctcctccctcaccctctcgcctacttctcgtaccctctctactcggcctgacagggctgcgtcctaaccagagtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtccgccatttcccccaacgccccatttgtatataagatgcagcctaccgttcctttccctctcggctggcctttgtacttag

SEQ ID NO: 12705 - DNA, 363 bp, Artificial
  Mutation in BnaA.FAD2.a introduced by TALE nuclease pair BnFAD2_T02
cctctcctccctcaccctctcccttacctcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12706 - DNA, 356 bp, Artificial
  Mutation in BnaA.FAD2.a introduced by TALE nuclease pair BnFAD2_T02
cctctcctccctcaccctctctcctacttcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12707 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 12708 - DNA, 306 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12709 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgcccccaagaagaagtcagacatcaagtggtacggcaagtacctcaacaaccctttgggacgcaccgtgatgttaacggttcagttcactctcggctggcctttgtacttag

SEQ ID NO: 12710 - DNA, 358 bp, Artificial
  Mutation in BnaA.FAD2.a introduced by TALE nuclease pair BnFAD2_T02
cctctcctccctcaccctctctcctacttcgcctggcccctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaacagtcatcgacgccaccattccaacaccggctccctcgagagagacgaaatgtttgtccccaagaagaagtcagacatcaagtggtacggcaagtacctcaacaaccctttgggacgcaccgtgatgttaacggttcagttcactctcggctggcctttgtacttag

SEQ ID NO: 12711 - DNA, 394 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtattgagtgagctgataccgctcgccgcagccgaacagtcatcgacgccaccattccaacactggctccctcgagagagacgaagtgtttgtccccaagaagaagtcagacatcaagtggtacggcaagtacctcaacatccctttgggacgcaccgtgatgttaacggttcagttcacgctcggctggcctttgtacttag

SEQ ID NO: 12712 - DNA, 322 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12713 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 12714 - DNA, 330 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggccttgtacttag

SEQ ID NO: 12715 - DNA, 416 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggacacaggccaacttctcaagattgcaaaacgtggcggcgtgaccgcagtggaggtacagtcatcgactccaccattccaacaccggctccctcgagagagacgaagtgtttgtccccaagaagaagtcagacatcaagtggtacggcaagtacctcaacaaccctttgggacgcaccgtgatgttaacggttcagttcactctcgcctggcatttgcacttag

SEQ ID NO: 12716 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgcctgggtcatagcccacgagtgcggccaccacgccttcagcgactaccagtggctggacgacaccgtcggcctcatcttccactccttcctcctcgtcccttacttctcctggaacatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 12717 - DNA, 367 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggcttgacgacaccgtcggcctcatcttccactccttcctcctcgtcccttacttctcctggaagtacacacacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12718 - DNA, 363 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtatacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 12719 - DNA, 417 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtccacgatcacgccgtagtcgatgggggagcccaatcctgttgccggtcttgcgatgattatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 12720 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtcccaagaagaagtcagacatcaagtggtacggcaagtacctcaacaaccctttgggacgcaccgtgatgttaacggttcagttcactctcggctggcctttgtacttag

SEQ ID NO: 12721 - DNA, 394 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacgccattgctggcgatggccaccacctgctggggggtcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12722 - DNA, 411 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgactaccagtggctggacgacaccgtcggcctcctcttccactccttcctcctcgtcccttacttctcctggaagtacgcgtaccgctagccaggaagagtttgtagaaacgcaaaaaggccatccccagtcattgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 12723 - DNA, 354 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12724 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccagtggctggacgacgccgtcggcctcgtcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12725 - DNA, 357 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttttacttag

SEQ ID NO: 12726 - DNA, 340 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcccaccattccaacaccggatccctcgatagggacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 12727 - DNA, 318 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcatctgggtcatcgcccacgaatgcggccaccacgccttcagcgaccaccagtggctggacgacaccgtcggtctcatcttccactccttcctcctcgtcccatacttcacctggaagtagacgaagtgtttgtccccaagaagaagtcagacatcaagtggtacggcaagtacctcaacaaccctctggaacgcaccgtgatgttaacggttcagttcaccctcggctgccatttgtacttag

SEQ ID NO: 12728 - DNA, 329 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgtgtcatagcccacgagtgcggccaccacgccttcagcgactaccagtggcttgacgacaccgtcggtctcatcttccacttacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 12729 - DNA, 351 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctgcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 12730 - DNA, 348 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgaccaccagtggctggacgacgccgtgggcctcgtcttccactccttcctcctcgtcccttacttcttcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12731 - DNA, 332 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12732 - DNA, 356 bp, Artificial
  Mutation in BnaA.FAD2.a introduced by TALE nuclease pair BnFAD2_T02
cctctcctccctccccctctcccttacctcgcctggcccctctactgcgcctgccaaggctgcgtcctaacgtgcctctgggtcatcgcccacgaatgcggccaccacgccttcagcgaccaccagtggctggacgacgccgtgggcctcgtcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacgtag

SEQ ID NO: 12733 - DNA, 444 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtacaagccgtgggcctggcacagcaccggcaacagccgctggaccgtctccagagaagtaatctgctgtttgcaaacaaaaaaaccagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12734 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12735 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacacccctgtgggacgcaccgtgatgttaacagttcagttcactctcggctggcctttgtacttag

SEQ ID NO: 12736 - DNA, 357 bp, Artificial
  Mutation in BnaA.FAD2.a introduced by TALE nuclease pair BnFAD2_T02
cctctcctccctcaccctctctcctacttcgcctggcctctctcctgggcctgccagggctgcgtcctaaccggcctctgggtcatcgcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtgcctcaacaaccctgtgggacgcaccgtgatggtaacggttgagttcactctcggcgggacgatgtacttag

SEQ ID NO: 12737 - DNA, 357 bp, Artificial
  Mutation in BnaA.FAD2.a introduced by TALE nuclease pair BnFAD2_T02
cctctcctccctcaccctctctcctacttcgcctggcctctctactgggcctgctaagggagcgtcctaaccggcgtgtgggtcatagcccacgagtgcggccaccactccttcagcgactaccagtggatggacgacaccgtcggcctcatcttccactccttcctcctcgtcccttacttctcctggaaagtcatcgacgccaccattccaacactggctccctcgagagagacgaagtgtttgtcccccagaagaagtcagacccccagtggtccgccaagtccctaaacaaccatttgggacgccccgtgctgttacacgttcagtccaccctcggctggcctttgtacttag

SEQ ID NO: 12738 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12739 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12740 - DNA, 356 bp, Artificial
  Mutation in BnaA.FAD2.a introduced by TALE nuclease pair BnFAD2_T02
cctctcctccctcaccctctctcctacttcgcctggcctctctgctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12741 - DNA, 350 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12742 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaggtcatcgacgccaccattccaacactggctccctcgagagagacgaagtgtttgtccccaagaagaagtcagacatcaagtggtacggcaagtacctcaacaacccgtttggacgcacggtgatgctaaccgtgcagttcactctcggctggcctttgtacttag

SEQ ID NO: 12743 - DNA, 357 bp, Artificial
  Mutation in BnaA.FAD2.a introduced by TALE nuclease pair BnFAD2_T02
cctctcctccctcaccctctcccttacctcgtctggcccctttactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagtcatcgacgccaccattccaacactggctccctcgagagagacgaagtgtttgtccccaagaagaagtcagacatcaagtggtacggcaagtccctcaacaccccagtgggacgcaccgggatgttaacggttcagttcactctcggctggcctttgtacttag

SEQ ID NO: 12744 - DNA, 426 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacacacgcgcacatcgttgcgttaagccaacacccggcagcgttagggaccgtcgctgtcaagtatcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12745 - DNA, 357 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 12746 - DNA, 342 bp, Artificial
  Mutation in BnaA.FAD2.a introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctggcacagcaccggcaaccgccgctggaagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 12747 - DNA, 339 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12748 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaatcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 12749 - DNA, 354 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaacatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggcttgcctttgtacttag

SEQ ID NO: 12750 - DNA, 356 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaaacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12751 - DNA, 345 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctattccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12752 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggtctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaacccgctaggacgcacggtgaggctaaccgtccagttcacgctcggctggccgttgtacttag

SEQ ID NO: 12753 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcggacatcaagtggtacggaaagtacctcaacaacccgctaggacgcacggtgatgctaaccgtccagttcacgctcggctggcctttgtacttag

SEQ ID NO: 12754 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 12755 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggaaagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 12756 - DNA, 359 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtaatcgcccacgaatgcggcaaccacgccttcagcgaccaccagtggctggacgacgccgtgggcctcgtcttccactccttcctcctcgtcccttacttctcctggaagtagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12757 - DNA, 344 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12758 - DNA, 401 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggactgccgctgccaagttcgagagacagcacatggacagcatcgatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactag

SEQ ID NO: 12759 - DNA, 356 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagtgactaccagtggctggacgacaccgtcggcctcatcttccactccttcctcctcgtcccttacttctcctggaagtcatcgacgccaccattccaacaccggatccctcgagagggatgaagtgtttgtccccaagaagaagtcatacatcaagtggtacggcaagtacctcaacaaccctttgggacgcaccgtgatgttaacggttcagttcactctcggctggcctttgtacttag

SEQ ID NO: 12760 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacagcgccgtgggcctcgtcttccactccttcctcctcgtcccttacttctcctggaaccatcgacgccaccattccaacactggctccctcgagagagacgaagtgtttgtccccaagaagaagtcagacatcaagtggtccggcaagtacctctacaaccctttgggacgcaccgtgatgttaacggttcagttcactctcggctggcctttgtacttag

SEQ ID NO: 12761 - DNA, 355 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12762 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactag

SEQ ID NO: 12763 - DNA, 358 bp, Artificial
  Mutation in BnaA.FAD2.a introduced by TALE nuclease pair BnFAD2_T02
cctctcctccctcaccctctctcctacttcgcctggcccctctcctcggcctgccaagggtgcgtcccaacctgcgtctgggtcatctcccacgagtgcggccaccacgccttcagctactaccagtggctggacgacaccagctgcctcatatatcactccttcctcctcgtcccttacttctcctggaacagtcatcgacgccaccattccaacaatggctccctcgagagagacgaagtgtttgtccccaagaagaaggcagacatcaactggtccgacaagtgcctcaacaaccttctgggacgcaccgtgatgttaacggttcaggtgactcgcggctggcatttgtacttag

SEQ ID NO: 12764 - DNA, 315 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12765 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaaccggcctctgggtcatcgcccacgaatgcggccaccacgccttcagcgaccaccagtggctggacgacgccgtgggcctcgtcttccactccttcctcctcgtcccttacttctcctggaagagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 12766 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12767 - DNA, 312 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggcttaacgacaccgtcggtctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12768 - DNA, 359 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 12769 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggagtgtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 12770 - DNA, 359 bp, Artificial
  Mutation in BnaA.FAD2.a introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12771 - DNA, 333 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12772 - DNA, 355 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgactaccagtggctggacgacaccgtcggcctcatcttccactccttcctcctcgtcccttacttctcctggagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 12773 - DNA, 358 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgactaccagtggctggacgacaccgtcggcctcatcttccactccttcctcctcgtcccttacttctcctggaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12774 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12775 - DNA, 347 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12776 - DNA, 353 bp, Artificial
  Mutation in BnaA.FAD2.a introduced by TALE nuclease pair BnFAD2_T02
cctctcctccctcaccctctcccttacctcgcctggcccctctactgggcctgccaaggctgcgtcctaacgggcctctgggtcatagcccacgagtgcggccaccacgccttcagcgactaccagtggctggacgacaccgtcggcctcatcttccactccttcctcctcgtcccttacttctcctggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12777 - DNA, 341 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactactagtggcttgacgacaccgtcggtctcatcttccactccttcctcctcgtcccttacttctcctggaaattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12778 - DNA, 357 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 12779 - DNA, 336 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 12780 - DNA, 356 bp, Artificial
  Mutation in BnaA.FAD2.a introduced by TALE nuclease pair BnFAD2_T02
cctcttctccctcaccctctctcctacttcgcctggcctctccactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaaaacatcgacgccaccattccaacactggctccctcgagagagacgaagtgtttgtccccaagaagaagtcagacatcaagtggtacggcaagtacctcaacagccgtttgggacgcaccgtggtgttaacggttcagttcacgctcggctggcctttgtacttag

SEQ ID NO: 12781 - DNA, 345 bp, Artificial
  Mutation in BnaA.FAD2.a introduced by TALE nuclease pair BnFAD2_T02
cctctcctccctcaccctctcccttacctcgcctggccactctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacattccaacactggctccctcgagagagacgaagtgtttgtccccaagaagaagtcagacatcaagtggtacggcaagtacctcaacaaccctgtgggacgcaccgtgatgttaacggtgcagttcactctcggctggcctttgtacttag

SEQ ID NO: 12782 - DNA, 352 bp, Artificial
  Mutation in BnaA.FAD2.a introduced by TALE nuclease pair BnFAD2_T02
cctctcctccctcaccctctctcctacttcgcctggcctctctactgggcctgccaagggtgcgtcctaacgggcctctgggtcatcgcccacgaatgcggccaccacgccttcagcgaccaccagtggctggacgacgccgtgggcctcgtcttccactccttcctcctcgtcccttacttctcctggaatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12783 - DNA, 349 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 12784 - DNA, 347 bp, Artificial
  Mutation in BnaA.FAD2.a introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttatccatgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag
